United States Patent
Hood et al.

(10) Patent No.: US 9,002,652 B1
(45) Date of Patent: Apr. 7, 2015

(54) METHODS FOR IDENTIFYING AND USING ORGAN-SPECIFIC PROTEINS IN BLOOD

(75) Inventors: Leroy Hood, Seattle, WA (US); Biaoyang Lin, Bothell, WA (US)

(73) Assignee: Institute for Systems Biology, Seattle, WA (US)

( * ) Notice: Subject to any disclaimer, the term of this patent is extended or adjusted under 35 U.S.C. 154(b) by 1402 days.

(21) Appl. No.: 11/342,366

(22) Filed: Jan. 27, 2006

Related U.S. Application Data

(60) Provisional application No. 60/647,685, filed on Jan. 27, 2005, provisional application No. 60/683,071, filed on May 20, 2005.

(51) Int. Cl.
| | |
|---|---|
| *G01N 33/48* | (2006.01) |
| *C12Q 1/70* | (2006.01) |
| *G01N 33/68* | (2006.01) |
| *G06K 9/00* | (2006.01) |

(52) U.S. Cl.
CPC ............ *G01N 33/68* (2013.01); *G01N 33/6893* (2013.01); *G06K 9/00127* (2013.01)

(58) Field of Classification Search
CPC ........................... G06K 9/00127; G01N 33/68
See application file for complete search history.

(56) References Cited

U.S. PATENT DOCUMENTS

| | | | |
|---|---|---|---|
| 5,863,722 | A | 1/1999 | Brenner |
| 6,013,445 | A | 1/2000 | Albrecht et al. |
| 6,140,489 | A | 10/2000 | Brenner |
| 6,172,214 | B1 | 1/2001 | Brenner |
| 6,172,218 | B1 | 1/2001 | Brenner |
| 6,539,102 | B1 * | 3/2003 | Anderson et al. ............ 382/128 |
| 2002/0095259 | A1 | 7/2002 | Hood et al. |
| 2006/0009633 | A9 * | 1/2006 | Dumas Milne Edwards et al. ............ 536/23.5 |

OTHER PUBLICATIONS

Anderson and Seilhamer, "A comparison of selected mRNA and protein abundances in human liver," Electrophoresis (1997) 18:533-537.
Bao et al., "High-sensitivity detection of DNA hybridization on microarrays using resonance light scattering," Anal. Chem. (2002) 74:1792-1797.
Bendtsen et al., "Improved prediction of signal peptides: SignalP 3.0," J. Mol. Biol. (2004) 340:783-795.
Blomberg et al., "Interlaboratory reproducibility of yeast protein patterns analyzed by immobilized pH gradient two-dimensional gel electrophoresis," Electrophoresis (1995) 16:1935-1945.
Brenner et al., "Gene expression analysis by massively parallel signature sequencing (MPSS) on microbead arrays," Nat. Biotechnol. (2000) 18:630-634.
Chen et al., "Secreted protein prediction system combining CJ-SPHMM, TMHMM, and PSORT," Mamm Genome (2003) 14:859-865.
Corbett et al., "Positional reproducibility of protein spots in two-dimensional polyacrylamide gel electrophoresis using immobilised pH gradient isoelectric focusing in the first dimension: an interlaboratory comparison," Electrophoresis (1994) 15:1205-1211.
Corthals et al., "Prefractionation of protein samples prior to two-dimensional electrophoresis," Electrophoresis (1997) 18:317-323.
Han et al., "Quantum-dot-tagged microbeads for multiplexed optical coding of biomolecules," Nat. Biotechnol. (2001) 19:631-635.
Han et al., "Quantitative profiling of differentiation-induced microsomal proteins using isotope-coded affinity tags and mass spectrometry," Nat. Biotechnol. (2001) 19:946-951.
Heller et al., "Discovery and analysis of inflammatory disease-related genes using cDNA microarrays," PNAS USA (1997) 94:2150-2155.
Jongeneel et al., "Comprehensive sampling of gene expression in human cell lines with massively parallel signature sequencing," PNAS USA (2003) 100(8):4702-4705.
Lopez and Patton, "Reproducibility of polypeptide spot positions in two-dimensional gels run using carrier ampholytes in the isoelectric focusing dimension," Electrophoresis (1997) 18:338-343.
Man et al., "POWER_SAGE: comparing statistical tests for SAGE experiments," Bioinformatics (2000) 16:953-959.
Meyers et al., "The use of MPSS for whole-genome transcriptional analysis in Arabidopsis," Genome Res. (2004) 14:1641-1653.
Ramsby et al., "Differential detergent fractionation of isolated hepatocytes: biochemical, immunochemical and two-dimensional gel electrophoresis characterization of cytoskeletal and noncytoskeletal compartments," Electrophoresis (1994) 15:265-277.
Schena et al., "Parallel human genome analysis: microarray-based expression monitoring of 1000 genes," PNAS USA (1996) 93:10614-10619.
Tuteja et al., "Serial analysis of gene expression (SAGE): unraveling the bioinformatics tools," Bioessays. (2004) 26(8):916-922.
Velculescu et al., "Analysing uncharted transcriptomes with SAGE," Trends Genet (2000) 16:423-425.

* cited by examiner

*Primary Examiner* — Anna Skibinsky
(74) *Attorney, Agent, or Firm* — Pabst Patent Group LLP

(57) ABSTRACT

The present invention relates generally to methods for identifying organ-specific secreted proteins and for identifying organ-specific molecular blood fingerprints therefrom. As such, the present invention provides compositions comprising such proteins, detection reagents for detecting such proteins, and panels, and arrays for determining organ-specific molecular blood fingerprints.

4 Claims, No Drawings

METHODS FOR IDENTIFYING AND USING ORGAN-SPECIFIC PROTEINS IN BLOOD

STATEMENT OF GOVERNMENT INTEREST

This invention was made with government support under Grant Nos. P50 CA097186 and P01 CA085857 awarded by the National Cancer Institute. The government may have certain rights in this invention.

STATEMENT REGARDING SEQUENCE LISTING SUBMITTED ON CD-ROM

The Sequence Listing associated with this application is provided on CD-ROM in lieu of a paper copy, and is hereby incorporated by reference into the specification. Three CD-ROMs are provided, containing identical copies of the sequence listing: CD-ROM No. 1 is labeled COPY 1, contains the file 401.app.txt which is 3.31 MB and created on Jan. 27, 2006; CD-ROM No. 2 is labeled COPY 2, contains the file 401.app.txt with is 3.31 MB and created on Jan. 27, 2006; CD-ROM No. 3 is labeled CRF (Computer Readable Form), contains the file 401.app.txt which is 3.31 KB and created on Jan. 27, 2006.

BACKGROUND OF THE INVENTION

1. Field of the Invention

The present invention relates generally to methods for identifying organ-specific proteins that are secreted into the blood. The invention further relates to methods of diagnosis and methods of use of such proteins.

2. Description of the Related Art

The ability to detect the onset of disease very early has been a longtime goal of the diagnostic field. Early detection will in most cases permit the disease to be effectively dealt with. For example, with most cancers, early detection would permit a patient to be cured by conventional therapies (chemotherapy, radiation, surgery). Hence early diagnosis is the cornerstone of dealing effectively with many diseases.

Differentially expressed proteins, particularly proteins found in blood, may serve as biological markers that can be measured for diagnostic (or therapeutic) purposes. Different approaches for measuring blood proteins have been used with varying degrees of success. In particular, two-dimensional (2-DE) gel electrophoresis is widely used for analysis of proteomic patterns in blood and other tissues. However, several limitations restrict its utility in diagnostic proteomics. First, because (2-DE) gels are limited to spatial resolution, it is difficult to resolve large numbers of proteins such as are expressed in the average cell (1,000 to 10,000 proteins) or even worse—blood. High abundance proteins can distort carrier ampholyte gradients in capillary isoelectric focusing electrophoresis (CGE) and result in crowding in the gel matrix of size sieving electrophoretic methods (e.g., the second dimension of (2-DE) gel electrophoresis and CGE), thus causing irreproducibility in the spatial pattern of resolved proteins (see e.g., Corthals, G. L., et al. *Electrophoresis*, 18:317 (1997). Lopez, M. F., and W. F. Patton, *Electrophoresis*, 18:338 (1997)). Note, for example, that albumen constitutes about 51% of the blood protein. Indeed, 22 proteins constitute about 99% of the blood protein and most of these will not be useful diagnostic markers—those will be present in the 1% of the remaining proteins that are often hidden by the abundant proteins. High abundance proteins can also precipitate in a gel and cause streaking of fractionated proteins (Corthals, G. L., et al., supra). Variations in the crosslinking density and electric field strength in cast gels can further distort the spatial pattern of resolved proteins. Another problem is the inability to resolve low abundance proteins neighboring high abundance proteins in a gel because of the high staining background and limited dynamic range of gel staining and imaging techniques. Limitations with staining also make it difficult to obtain reproducible and quantifiable protein concentration values, with average standard variations in relative protein abundance between replicate (2-DE) gels reported to be 20% and as high as 45% (Anderson, L. and J. Seilhamer, *Electrophoresis*, 18:533 (1997)). For example, investigators were only able to match 62% of the spots formed on 3-7 gels run under similar conditions (Lopez, M. F., and W. F. Patton, supra; see also Blomber, A., et al., *Electrophoresis*, 16:1935 (1995) and Corbett, J. M., et al., *Electrophoresis*, 15:1205 (1994)). Additionally, many proteins are not soluble in buffers compatible with acrylamide gels, or fail to enter the gel efficiently because of their high molecular weight (see e.g., Ramsby, M., et al., *Electrophoresis*, 15:265 (1994)).

Thus, a major stumbling block in the diagnostic proteomic analysis of the blood is the high degree of complexity of the blood proteome. Another major challenge is the large dynamic range across which proteins are expressed—about $10e^{10}$. This means that one protein may be present at one copy in a given volume, whereas another may be present at $10e^{10}$ copies. Additionally, pattern analysis using techniques such as 2-DGE and other similar techniques has been problematic primarily as a result of the irreproducibility of the gel patterns, inability to detect very low abundance proteins, difficulty in quantitating the individual spots (e.g., proteins) that make up a complex proteomic pattern and the inability to identify the individual proteins that constitute the complex pattern. Further, the ability to extend these techniques to easy, consistent, and high throughput diagnostic assays has been extremely limited. Thus, there is a need in the art to provide such diagnostic assays. The present invention provides for methods and assays that fulfill these and other needs.

BRIEF SUMMARY OF THE INVENTION

One aspect of the invention provides a method for identifying organ-specific proteins secreted into the blood comprising, generating a signature sequence from transcripts from a sample from a specific organ; identifying transcripts that are specifically expressed in the organ; identifying from the transcripts in (b) those transcripts that encode secreted proteins; and thereby identifying organ-specific proteins secreted into the blood.

Another aspect of the invention provides a method for identifying organ-specific proteins secreted into the blood comprising, generating a signature sequence from substantially all transcripts from a sample from a specific organ; comparing the signature sequences to a database of known sequences to determine the identity of the transcript; comparing the identified transcripts to transcripts expressed in other organs; removing any transcripts that are substantially expressed in other organs; identifying computationally from the remaining transcripts those that encode a signal peptide; confirming the presence of the secreted proteins in a blood sample; and thereby identifying organ-specific proteins secreted into the blood.

In a further aspect, the present invention provides a method for diagnosing a biological condition in a subject comprising measuring the level of a plurality of organ-specific proteins in the blood of the subject, wherein the plurality of organ-specific proteins are secreted from the same organ and wherein the levels of the plurality of organ-specific proteins together provide a diagnostic fingerprint for the biological condition in the subject. In one embodiment of the method, the level of the plurality of organ-specific proteins is measured using any one or more methods, such as mass spectrometry, an immunoassay such as an ELISA, Western blot, microfluidics/nanotechnology sensors, and aptamer capture assay. In this regard, an aptamer may be used in a similar manner to an antibody in a variety of appropriate binding assays known to the skilled artisan and described herein. In certain embodiments, the plurality of organ-specific proteins is measured using tandem mass spectrometry or other spectrometry-based techniques. In one embodiment, the plurality of organ-specific proteins comprises from at least about 1 or 2 organ-specific proteins to about 100, 150, 160, 170, 180, 190, 200, or more organ-specific proteins. In this regard, the plurality of organ-specific proteins may comprise at least 2, 3, 4, 5, 6, 7 8, 9, 10, or more organ-specific proteins. The plurality of organ-specific proteins may comprise about 10 or 20 organ-specific proteins. In one embodiment, the organ-specific proteins comprise prostate-specific proteins. In one embodiment, the prostate-specific proteins are selected from the proteins listed in Table 4 and Table 5. In other embodiments, the organ-specific proteins may be from any organ, such as liver, kidney, breast, ovary, etc. In one embodiment, the method is used to diagnose any of a variety of biological conditions, such as cancer. In this regard, the cancer can be any cancer, such as, but not limited to, brain cancer, bladder cancer, prostate cancer, ovarian cancer, breast cancer, liver cancer, lung cancer, pancreatic cancer, kidney cancer, and colon cancer. In a further embodiment, the biological condition is any one or combination of the following: cardiovascular disease, metabolic disease, infectious disease, genetic disease, autoimmune disease, and immune-related disease.

Another aspect of the present invention provides a method for determining the presence or absence of disease in a subject comprising, detecting a level of each of a plurality of organ-specific proteins in a blood sample from the subject, wherein the plurality of organ-specific proteins are secreted from the same organ; comparing the level of each of the plurality of organ-specific proteins in the blood sample from the subject to a level of the plurality of organ-specific proteins in a normal control sample of blood; wherein an altered level of one or more of the plurality of organ-specific proteins in the blood is indicative of the presence or absence of disease. As would be readily appreciated by the skilled artisan, an altered level can mean an increase in the level or a decrease in the level. In this regard, the skilled artisan would readily appreciate that a variety of statistical tests can be used to determine if an altered level is significant. The Z-test (Man, M. Z., et al., *Bioinformatics,* 16: 953-959, 2000) or other appropriate statistical tests can be used to calculate P values for comparison of protein expression levels. In certain embodiments, the level of each of the plurality of organ-specific proteins in the blood sample from the subject is compared to a previously determined normal control level of each of the plurality of organ-specific proteins taking into account standard deviation. In one embodiment, the level of each of the plurality of organ-specific proteins is detected using any one or more of a variety of methods, such as, but not limited to mass spectrometry, and immunoassays. In certain embodiments, the level of each of the plurality of organ-specific proteins is measured using mass spectrometry (e.g., tandem mass spectrometry) or an immunoassay such as an ELISA. In an additional embodiment, the level of each of the plurality of organ-specific proteins is measured using an antibody array.

A further aspect of the present invention provides a method for detecting perturbation of a normal biological state comprising, contacting a blood sample with a plurality of detection reagents each specific for an organ-specific protein secreted into blood, wherein each organ-specific protein is secreted from the same organ; measuring the amount of the organ-specific protein detected in the blood sample by each detection reagent, comparing the amount of the organ-specific protein detected in the blood sample by each detection reagent to a predetermined control amount for each organ-specific protein; wherein a statistically significant altered level in one or more of the organ-specific proteins indicates a perturbation in the normal biological state. Thus, in one embodiment, the predetermined control amount is determined from one or more normal blood samples. The skilled artisan would readily appreciate that a variety of statistical tests can be used to determine if an altered level of a given protein is significant. The Z-test (Man, M. Z., et al., *Bioinformatics,* 16: 953-959, 2000) or other appropriate statistical tests can be used to calculate P values for comparison of protein expression levels. In certain embodiments, the level of each of the plurality of organ-specific proteins in the blood sample from the subject is compared to a previously determined normal control level of each of the plurality of organ-specific proteins taking into account standard deviation (see e.g., U.S. Patent Application No. 20020095259). In an additional embodiment the plurality of detection reagents comprises from at least about 2 detection reagents to about 100, 150, 160, 170, 180, 190, 200, or more detection reagents. In a further embodiment, the plurality of detection reagents comprises about 5, 10 or about 20 detection reagents. In one embodiment, the organ-specific proteins comprise prostate-specific proteins, liver-specific proteins, or breast-specific proteins. In this regard, the organ-specific proteins can be from any organ, tissue, cell, or system as described further herein.

A further aspect of the present invention provides a diagnostic panel for determining the presence or absence of disease in a subject comprising, a plurality of detection reagents each specific for detecting one of a plurality of organ-specific proteins present in a blood sample; wherein the organ-specific proteins are secreted from the same organ and wherein detection of the plurality of organ-specific proteins with the plurality of detection reagents results in a fingerprint indicative of the presence or absence of disease in the subject. As noted elsewhere herein, the term "subject" is intended to include humans Thus, as further described herein, the organ-specific molecular blood fingerprint is unique for a given disease and further for a given stage of the disease and thus is a powerful diagnostic indicator. In one embodiment, the detection reagents comprise antibodies or antigen-binding fragments thereof. In a further embodiment, the antibodies are monoclonal antibodies, or antigen-binding fragments thereof. In one embodiment, the panel comprises one or more detection reagents. In yet a further embodiment, the plurality of detection reagents comprises from at least about 1 detection reagent to about 100, 150, 160, 170, 180, 190, 200 or more detection reagents. In yet a further embodiment, the plurality of detection reagents comprises at least 2, 3, 4, 5, 6, 7, 8, 9, or 10 detection reagents. In certain embodiments, the plurality of detection reagents comprises about 5, 10, or 20 detection reagents. In an additional embodiment, the organ-specific proteins comprise prostate-specific, liver-specific, or breast-specific proteins. As would be recognized by the skilled artisan upon reading the present disclosure, the organ-specific protein may be derived from any organ, tissue, cell, as described further herein. In a further embodiment, the panel is used for determining the presence or absence of a cancer. In this regard, the panel can be used to determine the presence or absence of any cancer, including but not limited to any one or more of prostate cancer, ovarian cancer, breast cancer, liver cancer, lung cancer, pancreatic cancer, kidney cancer, and colon cancer. In an additional embodiment, the panel can be used to determine the presence or absence of any disease including but not limited to the following diseases: cardiovascular disease, metabolic disease, infectious disease, genetic disease, autoimmune disease, immune-related disease, neurological disease and cancer.

An additional aspect of the present invention provides an assay device comprising a panel of detection reagents wherein each detection reagent in the panel, with the exception of a negative and positive control, is capable of specific interaction with one of a plurality of organ-specific proteins secreted into the blood, wherein the plurality of organ-specific proteins are secreted from the same organ and wherein the pattern of interaction between the detection reagents and the organ-specific proteins present in a blood sample is indicative of a biological condition. In certain embodiments, the pattern of interaction is the combination of, a snapshot of sorts, of the different quantitative levels of the organ-specific proteins detected. Thus, in certain embodiments, the pattern of interaction is a set of numbers, each number corresponding to a level of a particular organ-specific protein. This set of numbers and the specific organ-specific proteins that they correspond to together make up the pattern of interaction (e.g., fingerprint) that defines a biological condition.

A further aspect of the present invention provides a method for diagnosing a biological condition in a subject comprising measuring the level of a plurality of organ-specific proteins in the blood of the subject, wherein the organ-specific proteins are secreted from the same organ or specific to the same organ and wherein the levels of the plurality of organ-specific proteins together provide a fingerprint for the biological condition in the subject; thereby diagnosing the biological condition. In one embodiment, a statistically significant altered level in one or more of the organ-specific proteins as compared to a predetermined normal level classifies the subject as having a perturbation from the normal biological state. In this regard, identifying altered levels in one or more of the organ-specific proteins as compared to predetermined normal levels can be used for classifying subjects by disease and disease stage or generally as having a perturbation from the normal biological state. In a further embodiment, the fingerprint is measured in the blood, serum or plasma of the subject. In certain embodiments, the plurality of organ-specific proteins comprises at least 2 or more organ-specific proteins. In this regard, the plurality of organ-specific comprises about 5, 6, 7, 8, 9, 10, 11, 12, 13, 14, 15, 16, 17, 18, 19 or 20 organ-specific proteins. In certain embodiments, the biological condition affects the prostate and wherein the organ-specific proteins are prostate-specific proteins. In a further embodiment, the biological condition affects the breast and wherein the organ-specific proteins are breast-specific proteins. In yet a further embodiment, the biological condition comprises a cancer. In this regard, a cancer may include, but is not limited to, prostate cancer, ovarian cancer, breast cancer, liver cancer, lung cancer, pancreatic cancer, kidney cancer, or colon cancer. In another embodiment, the biological condition may include but is not limited to cardiovascular disease, metabolic disease, infectious disease, genetic disease, autoimmune disease, immune-related disease, neurological disease and cancer.

Another aspect of the invention provides a method for diagnosing a biological condition in a subject comprising measuring the level of one or more organ-specific proteins in the blood of the subject, wherein the organ-specific proteins are secreted from the same organ and wherein the levels of the one or more organ-specific proteins together provide a fingerprint for the biological condition in the subject; thereby diagnosing the biological condition.

A further aspect of the invention provides a method for determining the presence or absence of disease in a subject comprising, a) detecting the level of each of a plurality of organ-specific proteins in a blood sample from the subject, wherein the plurality of organ-specific proteins are secreted from the same organ; b) comparing said level of each of the plurality of organ-specific proteins in the blood sample from the subject to a previously-determined normal level of each of the plurality of each organ-specific protein; wherein a statistically significant altered level of one or more of the plurality of organ-specific proteins in the blood of the subject as compared to the previously-determined normal level is indicative of the presence or absence of disease. In this regard, the plurality of organ-specific proteins may be detected using any method described herein, such as mass spectrometry or an immunoassay. In one embodiment, the plurality of organ-specific proteins is measured using an antibody array.

A further aspect of the invention provides a method for detecting perturbation of a normal biological state in a subject comprising, a) contacting a blood sample from the subject with a plurality of detection reagents each specific for an organ-specific protein secreted into blood, wherein each organ-specific protein is secreted from the same organ; b) measuring the amount of the organ-specific protein detected in the blood sample by each detection reagent; c) comparing the amount of the organ-specific protein detected in the blood sample by each detection reagent to a predetermined control amount for each respective organ-specific protein; wherein a statistically significant altered level in one or more of the organ-specific proteins indicates a perturbation in the normal biological state.

Another aspect of the invention provides a method for detecting perturbation of a normal biological state in a subject, comprising, a) contacting a blood sample with one or more detection reagents wherein the one or more detection reagents are each specific for an organ-specific protein secreted into blood, wherein the organ-specific proteins are secreted from the same organ; b) measuring the amount of the organ-specific protein detected in the blood sample by the one or more detection reagents; c) comparing the amount of the organ-specific protein detected in the blood sample by the one or more detection reagents to a predetermined control amount for each respective organ-specific protein; wherein a statistically significant altered level in the one or more of the organ-specific proteins indicates a perturbation in the normal biological state. In this regard, the plurality of detection reagents may comprises about 3, 4, 5, 6, 7, 8, 9, 10, 11, 12, 13, 14, 15, 16, 17, 18, 19, or 20 detection reagents. In one embodiment, the perturbation from normal comprises perturbation of the prostate the organ-specific proteins are prostate-specific proteins. In another embodiment, the perturbation comprises perturbation of the liver and the organ-specific proteins are liver-specific proteins. In yet a further embodiment, the perturbation comprises perturbation of the breast and the organ-specific proteins are breast-specific proteins. In this regard, the perturbation may comprise a perturbation of any organ as described herein.

Another aspect of the invention provides a diagnostic panel for determining the presence or absence of disease in a subject comprising, a plurality of detection reagents each specific for detecting one of a plurality of organ-specific proteins present in a blood sample; wherein the organ-specific proteins are secreted from the same organ and wherein detection of the plurality of organ-specific proteins with the plurality of detection reagents results in a fingerprint indicative of the presence or absence of disease in the subject. In one embodiment, the detection reagents comprise antibodies or antigen-binding fragments thereof and in certain embodiments, the antibodies or antigen-binding fragments thereof are monoclonal antibodies, or antigen-binding fragments thereof.

A further aspect of the invention provides a diagnostic panel for determining the presence or absence of disease in a subject comprising, one or more detection reagents each specific for detecting an organ-specific protein present in a blood sample; wherein the organ-specific proteins are secreted from the same organ and wherein detection of the one or more organ-specific proteins with the one or more of detection reagents results in a fingerprint indicative of the presence or absence of disease in the subject. In one embodiment, the plurality of detection reagents comprises about 5, 6, 7, 8, 9, 10, 11, 12, 13, 14, 15, 16, 17, 18, 19, or 20 detection reagents. In a further embodiment, the organ-specific proteins comprise prostate-specific proteins, liver-specific proteins, breast-specific proteins. In another embodiment, the disease comprises a cancer. In this regard, the cancer may include but is not limited to prostate cancer, ovarian cancer, breast cancer, liver cancer, lung cancer, pancreatic cancer, kidney cancer, or colon cancer. In another embodiment the disease may include, but is not limited to, cardiovascular disease, metabolic disease, infectious disease, genetic disease, autoimmune disease, immune-related disease, neurological disease or cancer.

Another aspect of the invention provides a method for identifying organ-specific proteins secreted or shed into the blood comprising, generating a signature sequence from transcripts from a sample from a specific organ; identifying transcripts that are specifically expressed in the organ; identifying from the transcripts in (b) those transcripts that encode secreted proteins; thereby identifying organ-specific proteins secreted or shed into the blood.

A further aspect of the invention provides a method for identifying organ-specific proteins secreted or shed into the blood comprising, generating a signature sequence from transcripts from a sample from a specific organ; identifying transcripts that are expressed in the specific organ at least 1.5 fold as compared to the level of expression of the transcript observed in other organs; identifying from the transcripts in (b) those transcripts that encode secreted proteins; thereby identifying organ-specific proteins secreted or shed into the blood.

Another aspect of the invention provides a computer system for processing data relating to organ-specific molecular blood fingerprints, comprising: means operable to receive input identifying an organ-specific molecular blood fingerprint; an organ-specific molecular blood fingerprint database, the organ-specific molecular blood fingerprint database being a computer-readable collection of information about a set of organ-specific molecular blood fingerprints, the set including defined normal blood fingerprints from normal samples and defined disease blood fingerprints from samples from individuals diagnosed with a particular disease; means operable to receive organ-specific fingerprint information from a subject; means operable to use the organ-specific molecular blood fingerprint database and the organ-specific fingerprint information from the subject to match the subject fingerprint to a disease fingerprint, to a normal fingerprint, or to identify a fingerprint that is perturbed from normal but does not match to a disease fingerprint in the database.

BRIEF DESCRIPTION OF THE SEQUENCE IDENTIFIERS

SEQ ID NO:1 is the cDNA sequence that encodes the WDR19 prostate specific secreted protein.

SEQ ID NO:2. is the amino acid sequence of the WDR19 prostate specific secreted protein.

SEQ ID NOs:3-72 are MPSS signature sequences that correspond to differentially expressed genes in LNCaP cells (early prostate cancer phenotype) to androgen-independent CL1 cells (late prostate cancer phenotype) (see Table 1).

SEQ ID NOs:73-593 are MPSS signature sequences that correspond to differentially expressed genes in prostate cancer cell lines LNCaP and CL1 that encode secreted proteins (see Table 3).

SEQ ID NOs:594-1511 are the GENBANK sequences of differentially expressed genes that encode predicted secreted proteins as referred to in Table 3. Both polynucleotide and amino acid sequences are provided for each GENBANK accession number.

SEQ ID NOs:1512-1573 are the amino acid sequences from GENBANK of prostate-specific proteins potentially secreted into blood as described in Table 4.

SEQ ID NOs:1574-1687 are the GENBANK sequences of examples of differentially expressed genes as described in Table 1. Both polynucleotide and amino acid sequences are provided where available for each GENBANK accession number.

SEQ ID NOs:1688-1796 are MPSS signature sequences that correspond to prostate-specific/enriched genes as described in Table 5. SEQ ID NOs:1797-1947 are the GENBANK sequences of prostate-specific genes as described in Table 5. Both polynucleotide and amino acid sequences are provided where available for each GENBANK accession number.

DETAILED DESCRIPTION OF THE INVENTION

A powerful new systems approach to disease is revealing powerful new blood diagnostics approaches. Particularly, in specific cells there are protein and gene regulatory networks that mediate the normal functions of the cell. The disease process causes one or more of these networks to be perturbed, either genetically or environmentally (e.g. infections). The disease-altered networks result in altered patterns of protein expression—and some of the transcripts with altered expression levels are organ (cell)-specific and some of these organ-specific transcripts encode secreted proteins. Thus, disease leads to altered expression patterns of organ-specific, secreted proteins in the blood.

Hence the blood may be viewed as a window into the health and disease of an individual. The levels of organ-specific secreted proteins present in the blood taken together represent molecular fingerprints in the blood that reflect the operation of normal organs. Each organ has a specific quantitative molecular fingerprint. When disease attacks an organ, that blood fingerprint changes, for example, in the levels of these proteins expressed in the blood and the change in the fingerprint correlates with the specific disease. The changes in the fingerprints occur as a consequence of virtually any disease or organ perturbation with each disease fingerprint being unique. The changes in the fingerprints are sufficiently informative to carry out disease stratification, follow the progression of the particular disease stratification or type and follow responses to therapy. These fingerprints also allow one to stratify patients with regard to their ability to respond to particular therapies and even to visualize adverse effects of drugs. The disease fingerprints are determined by comparing the blood from normal individuals against that from patients with specific diseases at known stages. Not only will the absolute levels of the changes in the proteins constituting individual fingerprints be determined, but all the protein changes (e.g. N changed proteins) will be compared against one another to generate an N-dimensional shape space that will correlate even more powerfully with the disease stratifications and progression states described above (see e.g., U.S. Patent Application No. 20020095259).

In the studies described herein, the transcriptomes of two prostate cancer cell lines were analyzed: LNCaP, an androgen sensitive cell line, and hence a model for early stage of prostate cancer; and a variant of this cell, CL1, an androgen unresponsive cell line, thus, a model for late stage of prostate cancer. Analyses of the transcriptomes of these two cell lines revealed changes in cellular states that occur with the progression of prostate cancer. These transcriptomes were also compared to normal prostate tissue, prostate cancer tissues and prostate cancer metastases. These prostate transcriptomes were compared against their counterparts from 29 other tissues to identify those transcripts that are primarily expressed in the prostate. Computational approaches were used to predict which of these transcripts encode secreted proteins. Further, a prostate protein, referred to as WDR19, that was previously shown by microarray and northern analysis to be prostate-specific, was used in a multiparameter analysis of prostate cancer samples.

Thus, the present invention is generally directed to methods for identifying organ-specific secreted proteins present in the blood. The present invention is also directed to methods for defining organ-specific molecular blood fingerprints and further provides defined examples of predicted organ-specific molecular blood fingerprints. Additionally, the present invention is directed to panels of reagents or proteomic techniques employing mass spectrometry that detect organ-specific secreted proteins in the blood for use in diagnostics and other settings.

The blood fingerprints described herein enable physicians to develop a powerful new predictive medicine that can serve as one of the cornerstones for a revolution in medicine, moving it from a reactive mode (treating after the patient is sick) to more predictive, preventive and personalized modes.

By predefining the components of a given molecular blood fingerprint using the methods described herein, the present invention alleviates the need to blindly search for protein patterns using blood proteomics. Thus, the present invention enables the skilled artisan to 1) identify blood proteins which collectively constitute unique molecular blood fingerprints for healthy and diseased individuals; 2) identify unique fingerprints for each different disease; 3) identify fingerprints that can uniquely distinguish the different types of a particular disease (e.g., for prostate cancer, the ability to distinguish between benign disease, slowly growing disease and rapidly metastatic disease); 4) identify fingerprints that can reveal the stage of progression of each type of disease, and 5) fingerprints that will allow one to assess the response to therapy. Importantly, the potential organ-specific, secreted disease-detecting blood fingerprints can be predicted from a combination of quantitative comparative transcriptome studies and computational methods to predict which transcripts encode secreted proteins. The methods for determining the organ-specific, blood fingerprints for all organs described herein allow disease detection at very early stages, since even in the earliest disease stages, the cellular networks which control the expression patterns of these blood molecular signatures will be perturbed. Hence the present invention allows detection of virtually any type of disease and detection of each disease at a very early stage.

Methods for Identifying Organ-Specific Proteins Secreted Into the Blood

The invention provides methods for identifying organ-specific secreted proteins. In this regard, as used herein, the term "organ" is defined as would be understood in the art. Thus, the term, "organ-specific" as used herein generally refers to proteins (or transcripts) that are primarily expressed in a single organ. It should be noted that the skilled artisan would readily appreciate upon reading the instant specification that cell-specific transcripts and proteins and tissue-specific transcripts and proteins are also contemplated in the present invention. As such, and as discussed further herein, in certain embodiments, organ-specific protein is defined as a protein encoded by a transcript that is expressed at a level of at least 3 copies/million (as measured, for example, by massively parallel signature sequencing (MPSS) in the cell/tissue/organ of interest but is expressed at less than 3 copies/million in other cells/tissues/organs. In a further embodiment, an organ-specific protein is one that is encoded by a transcript that is expressed 95% in one organ and the remaining 5% in one or more other organs. (In this context, total expression across all organs examined is taken as 100%).

In certain embodiments, an organ-specific protein is one that is encoded by a transcript that is expressed at about 50%, 55%, 60%, 65%, 70%, 75%, 80% to about 90% in one organ and wherein the remaining 10%-50% is expressed in one or more other organs. As would be readily recognized by the skilled artisan upon reading the present disclosure, in certain embodiments, an organ-specific molecular blood fingerprint can readily be discerned even if some expression of an "organ-specific" protein from a particular organ is detected at some level in another organ, or even more than one organ. For example, the organ-specific molecular blood fingerprint from prostate can conclusively identify a particular prostate disease (and stage of disease) despite expression of one or more protein members of the fingerprint in one or more other organs. Thus, an organ-specific protein as described herein may be predominantly or differentially expressed in an organ of interest rather than uniquely or specifically expressed in the organ. In this regard, in certain embodiments, differentially expressed means at least 1.5 fold expression in the organ of interest as compared to other organs. In another embodiment, differentially expressed means at least 2 fold expression in the organ of interest as compared to expression in other organs. In yet a further embodiment, differentially expressed means at least 2.5, 3, 3.5, 4, 4.5, 5 fold or higher expression in the organ of interest as compared to expression of the protein in other organs. As described elsewhere herein, "protein" expression can be determined by analysis of transcript expression using a variety of methods.

In one embodiment, the organ-specific proteins are identified by preparing a cDNA library from an organ of interest. Any organ of a mammalian body is contemplated herein. Illustrative organs include, but are not limited to, heart, kidney, ureter, bladder, urethra, liver, prostate, heart, blood vessels, bone marrow, skeletal muscle, smooth muscle, brain (amygdala, caudate nucleus, cerebellum, corpus callosum, fetal, hypothalamus, thalamus), spinal cord, peripheral nerves, retina, nose, trachea, lungs, mouth, salivary gland, esophagus, stomach, small intestines, large intestines, hypothalamus, pituitary, thyroid, pancreas, adrenal glands, ovaries, oviducts, uterus, placenta, vagina, mammary glands, testes, seminal vesicles, penis, lymph nodes, PBMC, thymus, and spleen. As noted above, upon reading the present disclosure, the skilled artisan would recognize that cell-specific and tissue-specific proteins are contemplated herein and thus, proteins specifically expressed in cells or tissues that make up such organs are also contemplated herein. In certain embodiments, in each of these organs transcriptomes are obtained for the cell types in which the disease of interest arises. For example, in the prostate there are two dominant types of cells—epithelial cells and stromal cells. About 98% of prostate cancers arise in epithelial cells. As such, in certain embodiments, "organ-specific" means the transcripts that are expressed in particular cell types of the organ of interest (e.g., prostate epithelial cells). In this regard, any cell type that makes up any of the organs described herein is contemplated herein. Illustrative cell types include, but are not limited to, epithelial cells, stromal cells, endothelial cells, endodermal cells, ectodermal cells, mesodermal cells, lymphocytes (e.g., B cells and T cells including CD4+ T helper 1 or T helper 2 type cells, CD8+ cytotoxic T cells), erythrocytes, keratinocytes, and fibroblasts. Particular cell types within organs or tissues may be obtained by histological dissection, by the use of specific cell lines (e.g., prostate epithelial cell lines), by cell sorting or by a variety of other techniques known in the art.

It should be noted that in certain embodiments, fingerprints can be determined from "organ-specific" proteins from multiple organs, such as from organs that share a common function or make up a system (e.g., digestive system, circulatory system, respiratory system, cardiovascular system, the immune system (including the different cells of the immune system, such as, but not limited to, B cells, T cells including CD4+ T helper 1 or T helper 2 type cells, regulatory T cells, CD8+ cytotoxic T cells, NK cells, dendritic cells, macrophages, monocytes, neutrophils, granulocytes, mast cells, etc.), the sensory system, the skin, brain and the nervous system, and the like).

Complementary DNA (cDNA) libraries can be generated using techniques known in the art, such as those described in Ausubel et al. (2001 *Current Protocols in Molecular Biology*, Greene Publ. Assoc. Inc. & John Wiley & Sons, Inc., NY, N.Y.); Sambrook et al. (1989 *Molecular Cloning*, Second Ed., Cold Spring Harbor Laboratory, Plainview, N.Y.); Maniatis et al. (1982 *Molecular Cloning*, Cold Spring Harbor Laboratory, Plainview, N.Y.) and elsewhere. Further, a variety of commercially available kits for constructing cDNA libraries are useful for making the cDNA libraries of the present invention. Libraries are constructed from organs/tissues/cells procured from normal subjects.

All or substantially all of the transcripts of the cDNA library, e.g., representing virtually or substantially all genes functioning in the organ of interest, are cloned and sequenced using any of a variety of techniques known in the art. In this regard, in certain embodiments, substantially all refers to a sample representing at least 80% of all genes functioning in the organ of interest. In a further embodiment, substantially all refers to a sample representing at least 85%, 90%, 95%, 96%, 97%, 98% 99% or higher of all genes functioning in the organ of interest. In one embodiment, substantially all the transcripts from a cDNA library are amplified, sorted and signature sequences generated therefrom according to the methods described in U.S. Pat. Nos. 6,013,445; 6,172,218; 6,172,214; 6,140,489 and Brenner, P., et al., *Nat Biotechnol*, 18:630-634 2000. Briefly, polynucleotide templates from a cDNA library of interest are cloned into a vector system that contains a vast set of minimally cross-hybridizing oligonucleotide tags (see U.S. Pat. No. 5,863,722). The number of tags is usually at least 100 times greater than the number of cDNA templates (see e.g., U.S. Pat. No. 6,013,445 and Brenner, P., et al., supra). Thus, the set of tags is such that a 1% sample taken of template-tag conjugates ensures that essentially every template in the sample is conjugated to a unique tag and that at least one of each of the different template cDNAs is represented in the sample with >99% probability (U.S. Pat. No. 6,013,445 and Brenner, P., et al., supra). The conjugates are then amplified and hybridized under stringent conditions to microbeads each of which has attached thereto a unique complementary, minimally cross-hybridizing oligonucleotide tag. The transcripts are then directly sequenced simultaneously in a flow cell using a ligation-based sequencing method (see e.g., U.S. Pat. No. 6,013,445). A short signature sequence of about 17-20 base pairs is generated simultaneously from each of the hundreds of thousands of beads (or more) in the flow cell, each having attached thereto copies of a unique transcript from the sample. This technique is termed massively parallel signature sequencing (MPSS).

In certain embodiments, other techniques may be used to evaluate the transcripts from a particular cDNA library, including microarray analysis (Han, M., et al., *Nat Biotechnol*, 19: 631-635, 2001; Bao, P., et al., *Anal Chem*, 74: 1792-1797, 2002; Schena et al., *Proc. Natl. Acad. Sci.* USA 93:10614-19, 1996; and Heller et al., *Proc. Natl. Acad. Sci.* USA 94:2150-55, 1997) and SAGE (serial analysis of gene expression). Like MPSS, SAGE is digital and can generate a large number of signature sequences. (see e.g., Velculescu, V. E., et al., *Trends Genet*, 16: 423-425, 2000; Tuteja R. and Tuteja N. *Bioessays*. 2004 August; 26(8):916-22) although the coverage is not nearly as deep as with MPSS.

The resulting sequences, (e.g., MPSS signature sequences), are generally about 20 bases in length. However, in certain embodiments, the sequences can be about 10, 15, 20, 25, 30, 35, 40, 45, 50, 55, 60, 65, 70, 75, 80, 85, 90, 95, or 100 or more bases in length. The sequences are annotated using annotated human genome sequence (such as human genome release hg16, released in November, 2003, or other public or private databases) and the human Unigene (Unigene build #184) using methods known in the art, such as the method described by Meyers, B. C., et al., Genome Res, 14: 1641-1653, 2004. Other databases useful in this regard include Genbank, EMBL, or other publicly available databases. In certain embodiments, transcripts are considered only for those with 100% matches between an MPSS or other type of signature and a genome signature. As would be readily appreciated by the skilled artisan upon reading the present disclosure, this is a stringent match criterion and in certain embodiments, it may be desirable to use less stringent match criteria. Indeed, polymorphisms could lead to variations in transcripts that would be missed if only exact matches were used. For example, it may be desirable to consider signature sequences that match a genome signature with 80%, 85%, 90%, 95%, 96%, 97%, 98%, or 99% identity. In one embodiment, signatures that are expressed at less than 3 transcripts per million in libraries of interest are disregarded, as they might not be reliably detected since this, in effect, represents less than one transcript per cell (see for example, Jongeneel, C. V., et al., *Proc Natl Acad Sci USA,* 2003). cDNA signatures are classified by their positions relative to polyadenylation signals and poly (A) tails and by their orientation relative to the 5'→3' orientation of source mRNA. Full-length sequences corresponding to the signature sequences can be thus identified.

In order to identify organ-specific transcripts, the resulting annotated transcripts are compared against public and/or private sequence databases, such as a variety of annotated human genome sequence databases (e.g., Genebank, the EMBL and Japanese databases and databases generated and compiled from other normal tissues, to identify those transcripts that are expressed primarily in the organ of interest but are not expressed in other organs. As noted elsewhere herein, some expression in organs other than the organ of interest does not necessarily preclude the use of a particular transcript in a blood molecular signature panel of the present invention.

Comparisons of the transcripts between databases can be made using a variety of computer analysis algorithms known in the art. As such, alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection. As would be understood by the skilled artisan, many algorithms are available and are continually being developed. Appropriate algorithms can be chosen based on the specific needs for the comparisons being made (See also, e.g., J. A. Cuff, et al., *Bioinformatics,* 16(2):111-116, 2000; S. F Altschul and B. W. Erickson. *Bulletin of Mathematical Biology,* 48(5/6):603-616, 1986; S. F. Altschul and B. W. Erickson. *Bulletin of Mathematical Biology,* 48(5/6):633-660, 1986; S. F. Altschul, et al., *J. Mol. Bio.,* 215:403-410, 1990; K. Bucka-Lassen, et al., *BIOINFORMATICS,* 15(2):122-130, 1999; K.-M. Chao, et al., *Bulletin of Mathematical Biology,* 55(3): 503-524, 1993; W. M. Fitch and T. F. Smith. *Proceedings of the National Academy of Sciences,* 80:1382-1386, 1983; A. D. Gordon. *Biometrika,* 60:197-200, 1973; O. Gotoh. *J Mol Biol,* 162:705-708, 1982; O. Gotoh. *Bulletin of Mathematical Biology,* 52(3):359-373, 1990; X. Huang, et al., *CABIOS,* 6:373-381, 1990; X. Huang and W. Miller. *Advances in Applied Mathematics,* 12:337-357, 1991; J. D. Thompson, et al., *Nucleic Acids Research,* 27(13):2682-2690, 1999).

In certain embodiments, a particular transcript is considered to be organ-specific when the number of transcripts/million as determined by MPSS is 3 or greater in the organ of interest but is less than 3 in all other organs. In another embodiment, a transcript is considered organ-specific if it is expressed in the organ of interest at a detectable level using a standard measurement (e.g., microarray analysis, quantitative real-time RT-PCR, MPSS, etc.) in the organ of interest but is not detectably expressed in other organs, using appropriate negative and positive controls as would be familiar to the skilled artisan. In a further embodiment, an organ-specific transcript is one that is expressed 95% in one organ and the remaining 5% in one or more other organs. (In this context, total expression across all organs examined is taken as 100%). In certain embodiments, an organ-specific transcript is one that is expressed at about 50%, 55%, 60%, 65%, 70%, 75%, 80% to about 90% in one organ and wherein the remaining 10%-50% is expressed in one or more other organs.

In another embodiment, organ-specific transcripts are identified by determining the ratio of expression of a transcript in the organ of interest as compared to other organs. In this regard, expression levels in the organ of interest of at least 2.0, 2.5, 3.0, 3.5, 4.0, 4.5, 5.0, 5.5, 6.0, 6.5, 7.0 fold or higher as compared to expression in all other organs is considered to be organ-specific expression.

As would be readily recognized by the skilled artisan upon reading the present disclosure, in certain embodiments, an organ-specific molecular blood fingerprint can readily be discerned even if some expression of an "organ-specific" protein from a particular organ is detected at some level in another organ, or even more than one organ. This is because the fingerprint (e.g., the combination of the levels of multiple proteins; the pattern of the expression levels of multiple markers) itself is unique despite that the expression levels of one or more individual members of the fingerprint may not be unique to a particular organ. For example, the organ-specific molecular blood fingerprint from prostate can conclusively identify a particular prostate disease (and stage of disease) despite some expression of one or more members of the fingerprint in one or more other organs. Thus the present invention relates to determining the presence or absence of a disease or condition or stage of disease based on a pattern (e.g., fingerprint) of markers measured concurrently using any one or more of a variety of methods described herein (e.g., antibody binding, mass spectrometry, and the like), rather than the measure of individual markers.

In further embodiments, specificity can be confirmed at the protein level using immunohistochemistry (IHC) and/or other protein measurement techniques known in the art (e.g., isotope-coded affinity tags and mass spectrometry, such as described by Han, D. K., et al., *Nat Biotechnol,* 19: 946-951, 2001). The Z-test (Man, M. Z., et al., *Bioinformatics,* 16: 953-959, 2000) or other appropriate statistical tests can be used to calculate P values for comparison of gene and protein expression levels between libraries from organs of interest.

Organ-specific sequences identified as described herein are further analyzed to determine which of the sequences encode secreted proteins. Proteins with signal peptides (classical secretory proteins) can be predicted using computation analysis known in the art. Illustrative methods include, but are not limited to the criteria described by Chen et al., *Mamm Genome,* 14: 859-865, 2003. In certain embodiments, such analyses are carried out using prediction servers, for example SignalP 3.0 server developed by The Center for Biological Sequence Analysis, Lyngby, Denmark (httpcolon double slash dot www dot cbs dot dtu dot dkslash services slash SignalP-3.0; see also, J. D. Bendtsen, et al., *J. Mol. Biol.,* 340:783-795, 2004.) and the TMHMM2.0 server (see for example A. Krogh, et al., *Journal of Molecular Biology,* 305 (3):567-580, January 2001; E. L. L. Sonnhammer, et al., In J. Glasgow, T. Littlejohn, F. Major, R. Lathrop, D. Sankoff, and C. Sensen, editors, *Proceedings of the Sixth International Conference on Intelligent Systems for Molecular Biology,* pages 175-182, Menlo Park, Calif., 1998. AAAI Press). Other prediction methods that can be used in the context of the present invention include those described for example, in S. Moller, M. D. R. et al., *Bioinformatics,* 17(7):646-653, July 2001. Nonclassical secretory secreted proteins (without signal peptides) can be predicted using, for example, the SecretomeP 2.0 server, (http colon double slash www dot cbs dot dtu dot dk slash services slash SecretomeP-2.0 slash/) with an odds ratio score >3.0. Updated versions of these analysis programs are also contemplated for use in the present methods as are other methods known in the art (e.g., PSORT (http colon double slash psort dot nibb dot acdot jp slash/) and Sigfind (http colon double slash 139.91.72.10 slash sigfindslash sigfind dot html).

Confirmation that the identified secreted proteins are present in blood can be carried out using a variety of methods known in the art. For example, the proteins can be expressed, purified, and specific antibodies can be made against them. The specific antibodies can then be used to test the presence of the protein in blood/serum/plasma by a variety of immunoaffinity based techniques (e.g., immunoblot, Western analysis, immunoprecipitation, ELISA, etc.). Antibodies specific for the organ-specific protein identified herein can also be used to study expression patterns of the identified proteins. It should be noted that in certain circumstances, the secreted protein may not be detectable in normal blood samples but will be detected in the blood as a result of perturbation due to disease or other environmental factors. Accordingly, both normal and disease samples are tested for the presence of the secreted protein and particularly for changes in levels of expression in the two states. As an alternative, aptamers (short DNA or RNA fragments with binding complementarity to the proteins of interest) may be used in assays similar to those described for antibodies (see for example, *Biotechniques*. 2001 February; 30(2):290-2, 294-5; *Clinical Chemistry*. 1999; 45:1628-1650). In addition, antibodies or aptamers may be used in connection with nanowires to create highly sensitive detections systems (see e.g., J. Heath et al., Science. 2004 Dec. 17; 306(5704):2055-6). In further embodiments, mass spectrometry-based methods can be used to confirm the presence of a particular protein in the blood.

As would be recognized by the skilled artisan, while the organ-specific secreted proteins, the levels of which make up a given fingerprint, need not be isolated, in certain embodiments, it may be desirable to isolate such proteins (e.g., for antibody production). As such, the present invention provides for isolated organ-specific secreted proteins or fragments or portions thereof and polynucleotides that encode such proteins. As used herein, the terms protein and polypeptide are used interchangeably. The terms "polypeptide" and "protein" encompass amino acid chains of any length, including full-length endogenous (i.e., native) proteins and variants of endogenous polypeptides described herein. Illustrative polypeptides of the present invention are described in Table 1 and Tables 3-5, the section entitled "Brief Description of the Sequence Identifiers" and are set forth in the sequence listing. "Variants" are polypeptides that differ in sequence from the polypeptides of the present invention only in substitutions, deletions and/or other modifications, such that either the variants' disease-specific expression patterns are not significantly altered or the polypeptides remain useful for diagnostics/detection of organ-specific blood fingerprints as described herein. For example, modifications to the polypeptides of the present invention may be made in the laboratory to facilitate expression and/or purification and/or to improve immunogenicity for the generation of appropriate antibodies and other binding agents, etc. Modified variants (e.g., chemically modified) of the polypeptides of organ-specific, secreted proteins may be useful herein, (e.g., as standards in mass spectrometry analyses of the corresponding proteins in the blood, and the like). As such, in certain embodiments, the biological function of a variant protein is not relevant for utility in the methods for detection and/or diagnostics described herein. Polypeptide variants generally encompassed by the present invention will typically exhibit at least about 70%, 75%, 80%, 85%, 86%, 87%, 88%, 89%, 90%, 91%, 92%, 93%, 94%, 95%, 96%, 97%, 98%, or 99% or more identity along its length, to a polypeptide sequence set forth herein. Within a polypeptide variant, amino acid substitutions are usually made at no more than 50% of the amino acid residues in the native polypeptide, and in certain embodiments, at no more than 25% of the amino acid residues. In certain embodiments, such substitutions are conservative. A conservative substitution is one in which an amino acid is substituted for another amino acid that has similar properties, such that one skilled in the art of peptide chemistry would expect the secondary structure and hydropathic nature of the polypeptide to be substantially unchanged. In general, the following amino acids represent conservative changes: (1) ala, pro, gly, glu, asp, gln, asn, ser, thr; (2) cys, ser, tyr, thr; (3) val, ile, leu, met, ala, phe; (4) lys, arg, his; and (5) phe, tyr, trp, his. Thus, a variant may comprise only a portion of a native polypeptide sequence as provided herein. In addition, or alternatively, variants may contain additional amino acid sequences (such as, for example, linkers, tags and/or ligands), usually at the amino and/or carboxy termini. Such sequences may be used, for example, to facilitate purification, detection or cellular uptake of the polypeptide.

When comparing polypeptide sequences, two sequences are said to be "identical" if the sequence of amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O. (1978) A model of evolutionary change in proteins—Matrices for detecting distant relationships. In Dayhoff, M. O. (ed.) *Atlas of Protein Sequence and Structure*, National Biomedical Research Foundation, Washington D.C. Vol. 5, Suppl. 3, pp. 345-358; Hein J. (1990) Unified Approach to Alignment and Phylogenes pp. 626-645 *Methods in Enzymology* vol. 183, Academic Press, Inc., San Diego, Calif.; Higgins, D. G. and Sharp, P. M. (1989) *CABIOS* 5:151-153; Myers, E. W. and Muller W. (1988) *CABIOS* 4:11-17; Robinson, E. D. (1971) *Comb. Theor* 11:105; Saitou, N. Nei, M. (1987) *Mol. Biol. Evol.* 4:406-425; Sneath, P. H. A. and Sokal, R. R. (1973) *Numerical Taxonomy—the Principles and Practice of Numerical Taxonomy*, Freeman Press, San Francisco, Calif.; Wilbur, W. J. and Lipman, D. J. (1983) *Proc. Natl. Acad., Sci. USA* 80:726-730.

Alternatively, optimal alignment of sequences for comparison may be conducted by the local identity algorithm of Smith and Waterman (1981) *Add. APL. Math* 2:482, by the identity alignment algorithm of Needleman and Wunsch (1970) *J. Mol. Biol.* 48:443, by the search for similarity methods of Pearson and Lipman (1988) *Proc. Natl. Acad. Sci. USA* 85: 2444, by computerized implementations of these algorithms (GAP, BESTFIT, BLAST, FASTA, and TFASTA in the Wisconsin Genetics Software Package, Genetics Computer Group (GCG), 575 Science Dr., Madison, Wis.), or by inspection.

Illustrative examples of algorithms that are suitable for determining percent sequence identity and sequence similarity include the BLAST and BLAST 2.0 algorithms, which are described in Altschul et al. (1977) *Nucl. Acids Res.* 25:3389-3402 and Altschul et al. (1990) *J. Mol. Biol.* 215:403-410, respectively. BLAST and BLAST 2.0 can be used, for example, to determine percent sequence identity for the polynucleotides and polypeptides of the invention. Software for performing BLAST analyses is publicly available through the National Center for Biotechnology Information.

An isolated polypeptide is one that is removed from its original environment. For example, a naturally occurring protein or polypeptide is isolated if it is separated from some or all of the coexisting materials in the natural system. In certain embodiments, such polypeptides are also purified, e.g., are at least about 90% pure, in some embodiments, at least about 95% pure and in further embodiments, at least about 99% pure.

In one embodiment of the present invention, a polypeptide comprises a fusion protein comprising an organ-specific secreted polypeptide. The present invention further provides, in other aspects, fusion proteins that comprise at least one polypeptide as described herein, as well as polynucleotides encoding such fusion proteins. The fusion proteins may comprise multiple polypeptides or portions/variants thereof, as described herein, and may further comprise one or more polypeptide segments for facilitating the expression, purification, detection, and/or activity of the polypeptide(s).

In certain embodiments, the proteins and/or polynucleotides, and/or fusion proteins are provided in the form of compositions, e.g., pharmaceutical compositions, vaccine compositions, compositions comprising a physiologically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives.

In general, organ-specific secreted polypeptides and polynucleotides encoding such polypeptides as described herein, may be prepared using any of a variety of techniques that are well known in the art. For example, a DNA sequence encoding an organ-specific secreted protein may be prepared by amplification from a suitable cDNA or genomic library using, for example, polymerase chain reaction (PCR) or hybridization techniques. Libraries may generally be prepared and screened using methods well known to those of ordinary skill in the art, such as those described in Sambrook et al., *Molecular Cloning: A Laboratory Manual*, Cold Spring Harbor Laboratories, Cold Spring Harbor, N.Y., 1989. cDNA libraries may be prepared from any of a variety of organs, tissues, cells, as described herein. Other libraries that may be employed will be apparent to those of ordinary skill in the art upon reading the present disclosure. Primers for use in amplification may be readily designed based on the polynucleotide sequences encoding organ-specific polypeptides as provided herein, for example, using programs such as the PRIMER3 program (http colon double slash www-genome dot wi dot mit dot edu/cgi-bin/primer/primer3_www dot cgi).

Polynucleotides encoding the organ-specific secreted polypeptides as described herein are also provided by the present invention. A polynucleotide as used herein may be single-stranded (coding or antisense) or double-stranded, and may be DNA (genomic, cDNA or synthetic) or RNA molecules. Thus, within the context of the present invention, a polynucleotide encoding a polypeptide may also be a gene. A gene is a segment of DNA involved in producing a polypeptide chain; it includes regions preceding and following the coding region (leader and trailer) as well as intervening sequences (introns) between individual coding segments (exons). Additional coding or non-coding sequences may, but need not, be present within a polynucleotide of the present invention, and a polynucleotide may, but need not, be linked to other molecules and/or support materials. An isolated polynucleotide, as used herein, means that a polynucleotide is substantially away from other coding sequences, and that the DNA molecule does not contain large portions of unrelated coding DNA, such as large chromosomal fragments or other functional genes or polypeptide coding regions. Of course, this refers to the DNA molecule as originally isolated, and does not exclude genes or coding regions later added to the segment by the hand of man.

Polynucleotides of the present invention may comprise a native sequence (i.e., an endogenous polynucleotide, for instance, a native or non-artificially engineered or naturally occurring gene as provided herein) encoding an organ-specific secreted protein, an alternate form of such a sequence, or a portion or splice variant thereof or may comprise a variant of such a sequence. Polynucleotide variants may contain one or more substitutions, additions, deletions and/or insertions such that the polynucleotide encodes a polypeptide useful in the methods described herein, such as for the detection of organ-specific proteins (e.g., wherein said polynucleotide variants encode polypeptides that can be used to generate detection reagents as described herein that are specific for an organ-specific secreted protein). In certain embodiments, variants exhibit at least about 70% identity, and in other embodiments, exhibit at least about 80%, 85%, 86%, 87%, 88%, 89%, identity and in yet further embodiments, at least about 90%, 91%, 92%, 93%, 94%, 95%, 96%, 97%, 98%, or 99% identity to a polynucleotide sequence that encodes a native organ-specific secreted polypeptide or an alternate form or a portion thereof. Illustrative polynucleotides of the present invention are described in Table 1 and Tables 3-5, the section entitled "Brief Description of the Sequence Identifiers" and are set forth in the sequence listing. The percent identity may be readily determined by comparing sequences using computer algorithms well known to those having ordinary skill in the art and described herein.

Polynucleotides that are complementary to the polynucleotides described herein, or that have substantial identity to a sequence complementary to a polynucleotide as described herein are also within the scope of the present invention. "Substantial identity", as used herein refers to polynucleotides that exhibit at least about 70% identity, and in certain embodiments, at least about 80%, 85%, 86%, 87%, 88%, 89%, 90%, 91%, 92%, 93%, 94%, 95%, 96%, 97%, 98%, or 99% identity to a polynucleotide sequence that encodes a native organ-specific secreted polypeptide as described herein. Substantial identity can also refer to polynucleotides that are capable of hybridizing under stringent conditions to a polynucleotide complementary to a polynucleotide encoding an organ-specific secreted protein. Suitable hybridization conditions include prewashing in a solution of 5×SSC, 0.5% SDS, 1.0 mM EDTA (pH 8.0); hybridizing at 50-65° C., 5×SSC, overnight; followed by washing twice at 65° C. for 20 minutes with each of 2×, 0.5× and 0.2×SSC containing 0.1% SDS. Nucleotide sequences that, because of code degeneracy, encode a polypeptide encoded by any of the above sequences are also encompassed by the present invention.

Oligonucleotide primers for amplification of the polynucleotides encoding organ-specific secreted proteins are also within the scope of the present invention. Many amplification methods are known in the art such as PCR, RT-PCR, quantitative real-time PCR, and the like. The PCR conditions used can be optimized in terms of temperature, annealing times, extension times and number of cycles depending on the oligonucleotide and the polynucleotide to be amplified. Such techniques are well known in the art and are described in, for example, Mullis et al., *Cold Spring Harbor Symp. Quant. Biol.*, 51:263, 1987; Erlich ed., *PCR Technology*, Stockton Press, NY, 1989. Oligonucleotide primers can be anywhere from 8, 9, 10, 11, 12, 13, 14, 15, 16, 17, 18, 19, 20, 21, 22, 23, 24, 25, 26, 27, 28, 29, or 30 nucleotides in length. In certain embodiments, the oligonucleotide primers of the present invention are typically 35, 40, 45, 50, 55, 60, or more nucleotides in length.

Organ-Specific Molecular Blood Fingerprints

The present invention also provides methods for defining organ-specific molecular blood fingerprints. Additionally, the present invention provides defined examples of organ-specific molecular blood fingerprints as described further herein.

Each normal organ controls the expression of a variety of genes, some of which are expressed at major levels at other organs or tissues in the body and some of which are expressed only in the organ of interest or at significantly increased levels in the organ of interest as compared to expression in other organs/tissues (e.g., at least 2 fold, at least 2.5 fold, at least 3.0 fold, at least 3.5 fold, at least 4.0 fold, at least 4.5 fold, or higher fold expression in the organ of interest as compared to other tissues. Some of the organ-specific transcripts encode proteins which can be secreted into the blood. Hence these secreted proteins constitute an organ-specific molecular fingerprint for that organ in the blood. Analysis of levels of these proteins in the blood provides organ-specific molecular blood fingerprints that are indicative of biological states. A biological state may be a normal, healthy state or a disease state (e.g., perturbation from normal). Thus, there are molecular fingerprints in the blood that reflect the operation of normal organs and each organ has a specific molecular fingerprint. These organ-specific blood fingerprints are perturbed when disease, or other agents such as drugs, affects the organ. Different diseases will alter the organ-specific blood fingerprints in different ways (e.g. alter the expression levels of the corresponding secreted proteins). Thus, a unique perturbed blood molecular fingerprint is associated with each type of distinct disease. In effect, each distinct disease, or stage of a disease, creates its own molecular blood fingerprint for each organ that it affects. As would be readily appreciated by the skilled artisan, each disease or stage of a disease can affect multiple organs. For example, in kidney cancer, a primary perturbation in the kidney-specific molecular blood fingerprint would occur. However, a secondary or indirect effect may also be observed in the bladder-specific molecular blood fingerprint. As another example, in liver cancer, perturbation of a liver-specific blood fingerprint as a primary indicator of disease would occur. However, secondary or indirect effects at other sites, for example in a lymphocyte-specific blood fingerprint, would also be observed. As described elsewhere herein, each disease type and stage results in a unique, identifiable fingerprint for each organ that it affects, for primary and secondary organs affected. Thus, multiple organ-specific molecular blood fingerprints can be used in combination to determine a particular biological state and the fingerprints may include those for the primary organ affected and/or for a secondary or indirect organ that is affected by a particular disease.

Most common diseases such as prostate cancer actually represent multiple distinct diseases that initially appear similar (e.g., benign and very slowly growing prostate cancer, slowly invasive prostate cancer and rapidly metastatic prostate cancer represent three different types of prostate cancer—the process of dividing individual prostate cancers into one of these three types is called stratification). The blood molecular fingerprints will be distinct for each of these disease types, thus allowing for the stratification of similar diseases and rapid intervention where necessary. The blood fingerprints will also be perturbed in unique ways as each type of disease progresses—hence the blood fingerprints will also permit the progression of disease to be followed. The blood fingerprints also change with therapy, and hence will permit the effectiveness of therapy to be followed, thereby allowing a physician to alter treatment accordingly. Further, the blood fingerprints change with exposure to a variety of environmental factors, such as drugs, and can be used to assess toxic or off target damage by the drug and it will even permit following the subsequent recovery from such adverse drug exposure.

Thus, an organ-specific molecular blood fingerprint for a given setting (e.g., a particular disease) is defined by the levels in the blood of the organ-specific proteins that make up the fingerprint. As such, an organ-specific molecular blood fingerprint for a given organ at any given time and in any given disease setting is determined by measuring the levels of each of a plurality of organ-specific proteins in the blood. It is the combination of the different levels in the blood of the organ-specific proteins that reveals a unique pattern that defines the fingerprint. Equally important, each of the levels of the proteins can be compared against one another to create an N-dimensional measure of the fingerprint space, a very powerful correlate to health and disease (see e.g., U.S. Patent Application No 20020095259). It should be noted that, in certain embodiments, an organ-specific molecular blood fingerprint may be comprised of the determined level in the blood of one or more organ-specific secreted proteins. In one embodiment, an organ-specific molecular blood fingerprint may comprise the determined level in the blood of anywhere from at least 1 to more than about 100, 200 or more organ-specific secreted proteins from a particular organ of interest. In one embodiment, the organ-specific molecular blood fingerprint comprises the quantitatively measured level in the blood of at least 2, 3, 4, 5, 6, 7, 8, 9, or 10 organ-specific secreted proteins. In another embodiment, the organ-specific molecular blood fingerprint comprises the determined level in the blood of at least, 11, 12, 13, 14, 15, 16, 17, 18, 19, 20, 21, 22, 23, 24, 25, 26, 28, 29, or 30 organ-specific secreted proteins. In a further embodiment, the organ-specific molecular blood fingerprint comprises the determined level in the blood of at least, 31, 32, 33, 34, 35, 36, 37, 38, 39, or 40 organ-specific secreted proteins. In yet a further embodiment, the organ-specific molecular blood fingerprint comprises the determined level in the blood of at least, 41, 42, 43, 44, 45, 46, 47, 48, 49, or 50 organ-specific secreted proteins. In an additional embodiment, the organ-specific molecular blood fingerprint comprises the determined level in the blood of 51, 52, 53, 54, 55, 56, 57, 58, 59, or 60 organ-specific secreted proteins. In another embodiment, the organ-specific molecular blood fingerprint comprises the determined level in the blood of 61, 62, 63, 64, 65, 66, 67, 68, 69, or 70 organ-specific secreted proteins. In further embodiments, the organ-specific molecular blood fingerprint comprises the determined level in the blood of 75, 80, 85, 90, 100, or more organ-specific secreted proteins.

It should be noted that in certain circumstances, an organ-specific molecular blood fingerprint can be defined (in part or entirely) merely by the presence or absence of one or a plurality of organ-specific proteins, and determining the exact level of each of a plurality of organ-specific proteins in the blood may not be necessary.

In a further embodiment, the disease (e.g., perturbed) molecular blood fingerprints for a particular organ are determined by comparing the blood from normal individuals against that from patients with specific diseases at known stages. A statistically significant change in the levels (e.g., an increase or a decrease) of one or more of the organ-specific proteins in the blood that comprise the fingerprint as compared to normal is indicative of a perturbation of the fingerprint and is useful in diagnostics of the particular disease and/or stage of disease. As discussed elsewhere herein, the fingerprint may be for the primary organ affected by the particular disease of interest, or a secondarily, indirectly affected organ. The skilled artisan would readily appreciate that a variety of statistical tests can be used to determine if an altered level of a given protein is significant. The Z-test (Man, M. Z., et al., *Bioinformatics*, 16: 953-959, 2000) or other appropriate statistical tests can be used to calculate P values for comparison of protein expression levels. In certain embodiments, the level of each of the plurality of organ-specific proteins in the blood sample from the subject is compared to a previously determined normal control level of each of the plurality of organ-specific proteins taking into account standard deviation. Thus, the present invention provides determined normal control levels of each of a plurality of organ-specific proteins that make up a particular molecular blood fingerprint.

Organ-specific molecular blood fingerprints can be determined using any of a variety of detection reagents in the context of a variety of methods for measuring protein levels. Any detection reagent that can specifically bind to or otherwise detect an organ-specific secreted protein as described herein is contemplated as a suitable detection reagent. Illustrative detection reagents include, but are not limited to antibodies, or antigen-binding fragments thereof, yeast ScFv, DNA or RNA aptamers, isotope labeled peptides, microfluidic/nanotechnology measurement devices and the like.

In one illustrative embodiment, a detection reagent is an antibody or an antigen-binding fragment thereof. Antibodies may be prepared by any of a variety of techniques known to those of ordinary skill in the art. See, e.g., Harlow and Lane, *Antibodies: A Laboratory Manual*, Cold Spring Harbor Laboratory, 1988. In general, antibodies can be produced by cell culture techniques, including the generation of monoclonal antibodies as described herein, or via transfection of antibody genes into suitable bacterial or mammalian cell hosts, in order to allow for the production of recombinant antibodies. In one technique, an immunogen comprising the polypeptide is initially injected into any of a wide variety of mammals (e.g., mice, rats, rabbits, sheep or goats). In this step, the polypeptides of this invention may serve as the immunogen without modification. Alternatively, particularly for relatively short polypeptides, a superior immune response may be elicited if the polypeptide is joined to a carrier protein, such as bovine serum albumin or keyhole limpet hemocyanin. The immunogen is injected into the animal host, usually according to a predetermined schedule incorporating one or more booster immunizations, and the animals are bled periodically. Polyclonal antibodies specific for the polypeptide may then be purified from such antisera by, for example, affinity chromatography using the polypeptide coupled to a suitable solid support.

In one embodiment, multiple target proteins or peptides are used in a single immune response to generate multiple useful detection reagents simultaneously. In one embodiment, the individual specificities are later separated out.

In certain embodiments, antibody can be generated by phage display methods (such as described by Vaughan, T. J., et al., *Nat Biotechnol*, 14: 309-314, 1996; and Knappik, A., et al., *Mol Biol*, 296: 57-86, 2000); ribosomal display (such as described in Hanes, J., et al., *Nat Biotechnol*, 18: 1287-1292, 2000), or periplasmic expression in *E. coli* (see e.g., Chen, G., et al., *Nat Biotechnol*, 19: 537-542, 2001.). In further embodiments, antibodies can be isolated using a yeast surface display library. See e.g., nonimmune library of $10^9$ human antibody scFv fragments as constructed by Feldhaus, M. J., et al., *Nat Biotechnol*, 21: 163-170, 2003. There are several advantages of this yeast surface display compared to more traditional large nonimmune human antibody repertoires such as phage display, ribosomal display, and periplasmic expression in *E. coli* 1). The yeast library can be amplified $10^{10}$-fold without measurable loss of clonal diversity and repertoire bias as the expression is under control of the tightly GAL1/10 promoter and expansion can be done under non induction conditions; 2) nanomolar-affinity scFvs can be routinely obtained by magnetic bead screening and flow-cytometric sorting, thus greatly simplified the protocol and capacity of antibody screening; 3) with equilibrium screening, a minimal affinity threshold of the antibodies desired can be set; 4) the binding properties of the antibodies can be quantified directly on the yeast surface; 5) multiplex library screening against multiple antigens simultaneously is possible; and 6) for applications demanding picomolar affinity (e.g. in early diagnosis), subsequent rapid affinity maturation (Kieke, M. C., et al., *J Mol Biol*, 307: 1305-1315, 2001.) can be carried out directly on yeast clones without further re-cloning and manipulations.

Monoclonal antibodies specific for an organ-specific secreted polypeptide of interest may be prepared, for example, using the technique of Kohler and Milstein, *Eur. J. Immunol.* 6:511-519, 1976, and improvements thereto. Briefly, these methods involve the preparation of immortal cell lines capable of producing antibodies having the desired specificity (i.e., reactivity with the polypeptide of interest). Such cell lines may be produced, for example, from spleen cells obtained from an animal immunized as described above. The spleen cells are then immortalized by, for example, fusion with a myeloma cell fusion partner, in certain embodiments, one that is syngeneic with the immunized animal. A variety of fusion techniques may be employed. For example, the spleen cells and myeloma cells may be combined with a nonionic detergent for a few minutes and then plated at low density on a selective medium that supports the growth of hybrid cells, but not myeloma cells. An illustrative selection technique uses HAT (hypoxanthine, aminopterin, thymidine) selection. After a sufficient time, usually about 1 to 2 weeks, colonies of hybrids are observed. Single colonies are selected and their culture supernatants tested for binding activity against the polypeptide. Hybridomas having high reactivity and specificity are preferred.

Monoclonal antibodies may be isolated from the supernatants of growing hybridoma colonies. In addition, various techniques may be employed to enhance the yield, such as injection of the hybridoma cell line into the peritoneal cavity of a suitable vertebrate host, such as a mouse. Monoclonal antibodies may then be harvested from the ascites fluid or the blood. Contaminants may be removed from the antibodies by conventional techniques, such as chromatography, gel filtration, precipitation, and extraction. The polypeptides of this invention may be used in the purification process in, for example, an affinity chromatography step.

A number of therapeutically useful molecules are known in the art which comprise antigen-binding sites that are capable of exhibiting immunological binding properties of an antibody molecule. The proteolytic enzyme papain preferentially cleaves IgG molecules to yield several fragments, two of which (the "F(ab)" fragments) each comprise a covalent heterodimer that includes an intact antigen-binding site. The enzyme pepsin is able to cleave IgG molecules to provide several fragments, including the "F(ab')$_2$" fragment which comprises both antigen-binding sites. An "Fv" fragment can be produced by preferential proteolytic cleavage of an IgM, and on rare occasions IgG or IgA immunoglobulin molecule. Fv fragments are, however, more commonly derived using recombinant techniques known in the art. The Fv fragment includes a non-covalent $V_H$::$V_L$ heterodimer including an antigen-binding site which retains much of the antigen recognition and binding capabilities of the native antibody molecule. Inbar et al. (1972) *Proc. Nat. Acad. Sci. USA* 69:2659-2662; Hochman et al. (1976) *Biochem* 15:2706-2710; and Ehrlich et al. (1980) *Biochem* 19:4091-4096.

A single chain Fv ("sFv") polypeptide is a covalently linked $V_H$::$V_L$ heterodimer which is expressed from a gene fusion including $V_H$- and $V_L$-encoding genes linked by a peptide-encoding linker. Huston et al. (1988) *Proc. Nat. Acad. Sci. USA* 85(16):5879-5883. A number of methods have been described to discern chemical structures for converting the naturally aggregated—but chemically separated—light and heavy polypeptide chains from an antibody V region into an sFv molecule which will fold into a three dimensional structure substantially similar to the structure of an antigen-binging site. See, e.g., U.S. Pat. Nos. 5,091,513 and 5,132,405, to Huston et al.; and U.S. Pat. No. 4,946,778, to Ladner et al.

Each of the above-described molecules includes a heavy chain and a light chain CDR set, respectively interposed between a heavy chain and a light chain FR set which provide support to the CDRS and define the spatial relationship of the CDRs relative to each other. As used herein, the term "CDR set" refers to the three hypervariable regions of a heavy or light chain V region. Proceeding from the N-terminus of a heavy or light chain, these regions are denoted as "CDR1," "CDR2," and "CDR3" respectively. An antigen-binding site, therefore, includes six CDRs, comprising the CDR set from each of a heavy and a light chain V region. A polypeptide comprising a single CDR, (e.g., a CDR1, CDR2 or CDR3) is referred to herein as a "molecular recognition unit." Crystallographic analysis of a number of antigen-antibody complexes has demonstrated that the amino acid residues of CDRs form extensive contact with bound antigen, wherein the most extensive antigen contact is with the heavy chain CDR3. Thus, the molecular recognition units are primarily responsible for the specificity of an antigen-binding site.

As used herein, the term "FR set" refers to the four flanking amino acid sequences which frame the CDRs of a CDR set of a heavy or light chain V region. Some FR residues may contact bound antigen; however, FRs are primarily responsible for folding the V region into the antigen-binding site, particularly the FR residues directly adjacent to the CDRS. Within FRs, certain amino residues and certain structural features are very highly conserved. In this regard, all V region sequences contain an internal disulfide loop of around 90 amino acid residues. When the V regions fold into a binding-site, the CDRs are displayed as projecting loop motifs which form an antigen-binding surface. It is generally recognized that there are conserved structural regions of FRs which influence the folded shape of the CDR loops into certain "canonical" structures—regardless of the precise CDR amino acid sequence. Further, certain FR residues are known to participate in non-covalent interdomain contacts which stabilize the interaction of the antibody heavy and light chains.

The detection reagents of the present invention may comprise any of a variety of detectable labels. The invention contemplates the use of any type of detectable label, including, e.g., visually detectable labels, fluorophores, and radioactive labels. The detectable label may be incorporated within or attached, either covalently or non-covalently, to the detection reagent.

Methods for measuring organ-specific protein levels from blood/serum/plasma include, but are not limited to, immunoaffinity based assays such as ELISAs, Western blots, and radioimmunoassays, and mass spectrometry based methods (matrix-assisted laser desorption ionization (MALDI), MALDI-Time-of-Flight (TOF), Tandem MS (MS/MS), electrospray ionization (ESI), Surface Enhanced Laser Desorption Ionization (SELDI)-TOF MS, liquid chromatography (LC)-MS/MS, etc). Other methods useful in this context include isotope-coded affinity tag (ICAT) followed by multi-dimensional chromatography and MS/MS. The procedures described herein for analysis of blood organ-specific protein fingerprints can be modified and adapted to make use of microfluidics and nanotechnology in order to miniaturize, parallelize, integrate and automate diagnostic procedures (see e.g., L. Hood, et al., *Science* 306:640-643; R. H. Carlson, et al., *Phys. Rev. Lett.* 79:2149 (1997); A. Y. Fu, et al., *Anal. Chem.* 74:2451 (2002); J. W. Hong, et al., *Nature Biotechnol.* 22:435 (2004); A. G. Hadd, et al., *Anal. Chem.* 69:3407 (1997); I. Karube, et al., *Ann. N.Y. Acad. Sci.* 750:101 (1995); L. C. Waters et al., *Anal. Chem.* 70:158 (1998); J. Fritz et al., *Science* 288, 316 (2000)).

It should be noted that when the term "blood" is used herein, any part of the blood is intended. Accordingly, for determining molecular blood fingerprints, whole blood may be used directly where appropriate, or plasma or serum may be used.

Panels/Arrays for Detecting Organ-Specific Molecular Blood Fingerprints

The present invention also provides panels/arrays for detecting the organ-specific blood fingerprints at any given time in a subject. The term "subject" is intended to include any mammal or indeed any vertebrate that may be used as a model system for human disease. Examples of subjects include humans, monkeys, apes, dogs, cats, mice, rats, fish, zebra fish, birds, horses, pigs, cows, sheep, goats, chickens, ducks, donkeys, turkeys, peacocks, chinchillas, ferrets, gerbils, rabbits, guinea pigs, hamsters and transgenic species thereof. Further subjects contemplated herein include, but are not limited to, reptiles and amphibians, e.g., lizards, snakes, turtles, frogs, toads, salamanders, and newts. In one embodiment, the panel/array of the present invention comprises one detection reagent that specifically detects an organ-specific secreted protein. In another embodiment, the panel/arrays are comprised of a plurality of detection reagents that each specifically detects an organ-specific secreted protein, wherein the levels of organ-specific secreted proteins taken together form a unique pattern that defines the fingerprint. In certain embodiments, detection reagents can be bispecific such that the panel/array is comprised of a plurality of bispecific detection reagents that may specifically detect more than one organ-specific secreted protein. The term "specifically" is a term of art that would be readily understood by the skilled artisan to mean, in this context, that the protein of interest is detected by the particular detection reagent but other proteins are not detected in a statistically significant manner under the same conditions. Specificity can be determined using appropriate positive and negative controls and by routinely optimizing conditions.

The panel/arrays may be comprised of a solid phase surface having attached thereto a plurality of detection reagents each attached at a distinct location. As would be recognized by the skilled artisan, the number of detection reagents on a given panel/array would be determined from the number of organ-specific secreted proteins in the fingerprint to be measured. In one embodiment, the panel/array comprises one or more detection reagents. In a further embodiment, the panel/array comprises a plurality of detection reagents, wherein the plurality of detection reagents may be anywhere from about 2 to about 100, 150, 160, 170, 180, 190, 200 or more detection reagents each specific for an organ-specific secreted protein. In one embodiment, the panel/array comprises at least 2, 3, 4, 5, 6, 7, 8, 9, or 10 detection reagents each specific for one of the plurality of organ-specific secreted proteins that make up a given fingerprint. In another embodiment, the panel/array comprises at least 11, 12, 13, 14, 15, 16, 17, 18, 19, or 20 detection reagents each specific for one of the plurality of organ-specific secreted proteins that make up a given fingerprint. In a further embodiment, the panel/array comprises at least 21, 22, 23, 24, 25, 26, 27, 28, 29, or 30 detection reagents each specific for one of the plurality of organ-specific secreted proteins that make up a given fingerprint. In an additional embodiment, the panel/array comprises at least 31, 32, 33, 34, 35, 36, 37, 38, 39, or 40 detection reagents each specific for one of the plurality of organ-specific secreted proteins that make up a given fingerprint. In yet a further embodiment, the panel/array comprises at least 41, 42, 43, 44, 45, 46, 47, 48, 49, or 50 detection reagents each specific for one of the plurality of organ-specific secreted proteins that make up a given fingerprint. In an additional embodiment, the panel/array comprises at least 51, 52, 53, 54, 55, 56, 57, 58, 59, or 60 detection reagents each specific for one of the plurality of organ-specific secreted proteins that make up a given fingerprint. In one embodiment, the panel/array comprises at least 61, 62, 63, 64, 65, 66, 67, 68, 69, or 70 detection reagents each specific for one of the plurality of organ-specific secreted proteins that make up a given fingerprint. In one embodiment, the panel/array comprises at least 75, 80, 85, 90, 100, 150, 160, 170, 180, 190, 200, or more, detection reagents each specific for one of the plurality of organ-specific secreted proteins that make up a given fingerprint.

Further in this regard, the solid phase surface may be of any material, including, but not limited to, plastic, polycarbonate, polystyrene, polypropylene, polyethlene, glass, nitrocellulose, dextran, nylon, metal, silicon and carbon nanowires, nanoparticles that can be made of a variety of materials and photolithographic materials. In certain embodiments, the solid phase surface is a chip. In another embodiment, the solid phase surface may comprise microtiter plates, beads, membranes, microparticles, the interior surface of a reaction vessel such as a test tube or other reaction vessel. In other embodiments the peptides will be fractionated by one or more one-dimensional columns using size separations, ion exchange or hydrophobicity properties and, for example, deposited in a MALDI 96 or 384 well plate and then injected into an appropriate mass spectrometer.

In one embodiment, the panel/array is an addressable array. As such, the addressable array may comprise a plurality of distinct detection reagents, such as antibodies or aptamers, attached to precise locations on a solid phase surface, such as a plastic chip. The position of each distinct detection reagent on the surface is known and therefore "addressable". In one embodiment, the detection reagents are distinct antibodies that each have specific affinity for one of a plurality of organ-specific polypeptides.

In one embodiment, the detection reagents, such as antibodies, are covalently linked to the solid surface, such as a plastic chip, for example, through the Fc domains of antibodies. In another embodiment, antibodies are adsorbed onto the solid surface. In a further embodiment, the detection reagent, such as an antibody, is chemically conjugated to the solid surface. In a further embodiment, the detection reagents are attached to the solid surface via a linker. In certain embodiments, detection with multiple specific detection reagents is carried out in solution.

Methods of constructing protein arrays, including antibody arrays, are known in the art (see, e.g., U.S. Pat. No. 5,489,678; U.S. Pat. No. 5,252,743; Blawas and Reichert, 1998, *Biomaterials* 19:595-609; Firestone et al., 1996, *J. Amer. Chem. Soc.* 18, 9033-9041; Mooney et al., 1996, *Proc. Natl. Acad. Sci.* 93,12287-12291; Pirrung et al, 1996, *Bioconjugate Chem.* 7, 317-321; Gao et al 1995, *Biosensors Bioelectron* 10, 317-328; Schena et al, 1995, *Science* 270, 467-470; Lom et al., 1993, *J. Neurosci. Methods,* 385-397; Pope et al., 1993, *Bioconjugate Chem.* 4, 116-171; Schramm et al., 1992, *Anal. Biochem.* 205, 47-56; Gombotz et al., 1991, *J. Biomed. Mater. Res.* 25, 1547-1562; Alarie et al., 1990, *Analy. Chim. Acta* 229, 169-176; Owaku et al, 1993, *Sensors Actuators B,* 13-14, 723-724; Bhatia et al., 1989, *Analy. Biochem.* 178, 408-413; Lin et al., 1988, *IEEE Trans. Biomed. Engng.,* 35(6), 466-471).

In one embodiment, the detection reagents, such as antibodies, are arrayed on a chip comprised of electronically activated copolymers of a conductive polymer and the detection reagent. Such arrays are known in the art (see e.g., U.S. Pat. No. 5,837,859 issued Nov. 17, 1998; PCT publication WO 94/22889 dated Oct. 13, 1994). The arrayed pattern may be computer generated and stored. The chips may be prepared in advance and stored appropriately. The antibody array chips can be regenerated and used repeatedly.

Using the methods described herein, a vast array of organ-specific molecular blood fingerprints can be defined for any of a variety of diseases as described further herein. As such, the present invention further provides information databases comprising data that make up molecular blood fingerprints as described herein. As such, the databases may comprise the defined differential expression levels as determined using any of a variety of methods such as those described herein, of each of the plurality of organ-specific secreted proteins that make up a given fingerprint in any of a variety of settings (e.g., normal or disease fingerprints).

Methods of Use

The present invention provides methods for identifying organ-specific secreted proteins and methods for identifying organ-specific molecular blood fingerprints. The present invention further provides panels+/arrays of detection reagents for detecting such fingerprints. The present invention also provides defined organ-specific molecular blood fingerprints for normal and disease settings. As such, the present invention provides methods of detecting diseases. The invention further provides methods for stratifying disease types and for monitoring the progression of a disease. The present invention also provides for following responses to therapy in a variety of disease settings and methods for detecting the disease state in humans using the visualization of nanoparticles with appropriate reporter groups and organ-specific antibodies or aptamers.

The present invention can be used as a standard screening test. In this regard, one or more of the detection panel/arrays described herein can be run on an individual and any statistically significant deviation from a normal organ-specific molecular blood fingerprint would indicate that disease-related perturbation was present. Thus, the present invention provides a standard or "normal" blood fingerprint for any given organ. In certain embodiments, a normal blood fingerprint is determined by measuring the normal range of levels of the individual protein members of a fingerprint. Any deviation therefrom or perturbation of the normal fingerprint that is outside the standard deviation (normal range) has diagnostic utility (see also U.S. Patent Application No. 0020095259). As would be recognized by the skilled artisan, the significance of any deviation in the levels of (e.g., a significantly altered level of one or more of) the individual protein members of a fingerprint can be determined using statistical methods known in the art and described herein. As noted elsewhere herein, perturbation of the normal fingerprint can indicate primary disease of the organ being tested or secondary, indirect affects on that organ resulting from disease of another organ.

In an additional embodiment, the present invention can be used to determine distinct normal organ-specific molecular fingerprints, such as in different populations of people. In this regard, distinct normal patterns of organ-specific molecular blood fingerprints may have differences in populations of patients that permit one to stratify patients into classes that would respond to a particular therapeutic regimen and those which would not.

In a further embodiment, the present invention can be used to determine the risk of developing a particular biological condition. A statistically significant alteration (e.g., increase or decrease) in the levels of one or more members of a particular molecular blood fingerprint may signify a risk of developing a particular disease, such as a cancer, an autoimmune disease, or other biological condition.

To monitor the progression of a disease, or monitor responses to therapy, one or more organ-specific molecular blood fingerprints are detected/measured as described herein using any of the methods as described herein at one time point and detected/measured again at subsequent time points, thereby monitoring disease progression or responses to therapy.

The organ-specific molecular blood fingerprints of the present invention can be used to detect any of a variety of diseases (or the lack thereof). In certain embodiments, the organ-specific molecular blood fingerprints of the present invention can be used to detect cancer. As such, the present invention can be used to detect, monitor progression of, or monitor therapeutic regimens for any cancer, including melanoma, non-Hodgkin's lymphoma, Hodgkin's disease, leukemias, plasmocytomas, sarcomas, adenomas, gliomas, thymomas, breast cancer, prostate cancer, colo-rectal cancer, kidney cancer, renal cell carcinoma, bladder cancer, uterine cancer, pancreatic cancer, esophageal cancer, brain cancer, lung cancer, ovarian cancer, cervical cancer, testicular cancer, gastric cancer, multiple myeloma, hepatoma, acute lymphoblastic leukemia (ALL), acute myelogenous leukemia (AML), chronic myelogenous leukemia (CML), and chronic lymphocytic leukemia (CLL), or other cancers.

In certain embodiments, the organ-specific molecular blood fingerprints of the present invention can be used to detect, to monitor progression of, or monitor therapeutic regimens for diseases of the heart, kidney, ureter, bladder, urethra, liver, prostate, heart, blood vessels, bone marrow, skeletal muscle, smooth muscle, various specific regions of the brain (including, but not limited to the amygdala, caudate nucleus, cerebellum, corpus callosum, fetal, hypothalamus, thalamus), spinal cord, peripheral nerves, retina, nose, trachea, lungs, mouth, salivary gland, esophagus, stomach, small intestines, large intestines, hypothalamus, pituitary, thyroid, pancreas, adrenal glands, ovaries, oviducts, uterus, placenta, vagina, mammary glands, testes, seminal vesicles, penis, lymph nodes, thymus, and spleen. The present invention can be used to detect, to monitor progression of, or monitor therapeutic regimens for cardiovascular diseases, neurological diseases, metabolic diseases, respiratory diseases, autoimmune diseases. As would be recognized by the skilled artisan, the present invention can be used to detect, monitor the progression of, or monitor treatment for, virtually any disease wherein the disease causes perturbation in organ-specific secreted proteins.

In certain embodiments, the organ-specific molecular blood fingerprints of the present invention can be used to detect autoimmune disease. As such, the present invention can be used to detect, monitor progression of, or monitor therapeutic regimens for autoimmune diseases such as, but not limited to, rheumatoid arthritis, multiple sclerosis, insulin dependent diabetes, Addison's disease, celiac disease, chronic fatigue syndrome, inflammatory bowel disease, ulcerative colitis, Crohn's disease, Fibromyalgia, systemic lupus erythematosus, psoriasis, Sjogren's syndrome, hyperthyroidism/Graves disease, hypothyroidism/Hashimoto's disease, Insulin-dependent diabetes (type 1), Myasthenia Gravis, endometriosis, scleroderma, pernicious anemia, Goodpasture syndrome, Wegener's disease, glomerulonephritis, aplastic anemia, paroxysmal nocturnal hemoglobinuria, myelodysplastic syndrome, idiopathic thrombocytopenic purpura, autoimmune hemolytic anemia, Evan's syndrome, Factor VIII inhibitor syndrome, systemic vasculitis, dermatomyositis, polymyositis and rheumatic fever.

In certain embodiments, the organ-specific molecular blood fingerprints of the present invention can be used to detect diseases associated with infections with any of a variety of infectious organisms, such as viruses, bacteria, parasites and fungi. Infectious organisms may comprise viruses, (e.g., RNA viruses, DNA viruses, human in virus (HIV), hepatitis A, B, and C virus, herpes simplex virus (HSV), cytomegalovirus (CMV) Epstein-Barr virus (EBV), human papilloma virus (HPV)), parasites (e.g., protozoan and metazoan pathogens such as Plasmodia species, *Leishmania* species, *Schistosoma* species, *Trypanosoma* species), bacteria (e.g., *Mycobacteria*, in particular, *M. tuberculosis, Salmonella, Streptococci, E. coli, Staphylococci*), fungi (e.g., *Candida* species, *Aspergillus* species), *Pneumocystis carinii*, and prions.

Business Methods

A further embodiment of the present invention comprises a business method of diagnosing a particular disease in a subject that comprises detecting an organ-specific molecular blood fingerprint as described herein.

Thus, the present invention contemplates methods for (a) manufacturing one or more of the detection reagents, panels, arrays, (b) providing diagnostic services for determining organ-specific blood fingerprints, (c) providing manufacturers of genomics devices the use of the detection reagents, panels, arrays, blood fingerprints or transcriptomes described herein to develop diagnostic devices, where the genomics device includes any device that may be used to define differences in a blood sample between the normal and disturbed state (d) providing manufacturers of proteomics devices the use of the detection reagents, panels, arrays, blood fingerprints or transcriptomes described herein to develop diagnostic devices, where the proteomics device includes any device that may be used to define differences in a blood sample between the normal and disturbed state and (e) providing manufacturers of imaging devices the use of the detection reagents, panels, arrays, blood fingerprints or transcriptomes described herein to develop diagnostic devices, where the proteomics device includes any device that may be used to define differences in a blood sample between the normal and disturbed state (f) providing manufacturers of molecular imaging devices the use of the detection reagents, panels, arrays, blood fingerprints or transcriptomes described herein to develop diagnostic devices, where the proteomics device includes any device that may be used to define differences in a blood sample between the normal and disturbed state and (g) marketing to healthcare providers the benefits of using the detection reagents, panels, arrays, and diagnostic services of the present invention to enhance diagnostic capabilities and thus, to better treat patients.

Another aspect of the invention relates to a method for conducting a business, which includes: (a) manufacturing one or more of the detection reagents, panels, arrays, (b) providing diagnostic services for determining organ-specific molecular blood fingerprints and (c) marketing to healthcare providers the benefits of using the detection reagents, panels, arrays, and diagnostic services of the present invention to enhance diagnostic capabilities and thus, to better treat patients.

Another aspect of the invention relates to a method for conducting a business, comprising: (a) providing a distribution network for selling the detection reagents, panels, arrays, diagnostic services, and access to organ-specific molecular blood fingerprint databases (b) providing instruction material to physicians or other skilled artisans for using the detection reagents, panels, arrays, and organ-specific molecular blood fingerprint databases to improve diagnostics for patients.

Yet another aspect of the invention relates to a method for conducting a business, comprising: (a) identifying organ-specific secreted proteins in the blood sera, etc. (b) determining the organ-specific molecular fingerprint for any of a variety of diseases as described herein and (c) providing a distribution network for selling access to the database of organ-specific molecular fingerprints identified in step (b).

For instance, the subject business method can include an additional step of providing a sales group for marketing the database, or panels, or arrays, to healthcare providers.

Another aspect of the invention relates to a method for conducting a business, comprising: (a) determining one or more organ-specific molecular blood fingerprints and (b) licensing, to a third party, the rights for further development and sale of panels, arrays, and information databases related to the organ-specific molecular blood fingerprints of (a).

The business methods of the present application relate to the commercial and other uses, of the methodologies, panels, arrays, organ-specific secreted proteins, organ-specific molecular blood fingerprints, and databases comprising identified fingerprints of the present invention. In one aspect, the business method includes the marketing, sale, or licensing of the present invention in the context of providing consumers, i.e., patients, medical practitioners, medical service providers, and pharmaceutical distributors and manufacturers, with all aspects of the invention described herein, (e.g., the methods for identifying organ-specific secreted proteins, detection reagents for such proteins, molecular blood fingerprints, etc., as provided by the present invention).

In a particular embodiment of the present invention, a business method relating to providing information related to molecular blood fingerprints (e.g., levels of the plurality of organ-specific secreted proteins that make up a given fingerprint), method for determining fingerprints and sale of panels for determining such molecular blood fingerprints. In a specific embodiment, that method may be implemented through the computer systems of the present invention. For example, a user (e.g. a health practitioner such as a physician or a diagnostic laboratory technician) may access the computer systems of the present invention via a computer terminal and through the Internet or other means. The connection between the user and the computer system is preferably secure.

In practice, the user may input, for example, information relating to a patient such as the patient's disease state e.g., levels determined for the proteins that make up a given molecular blood fingerprint using a panel or array of the present invention. The computer system may then, through the use of the resident computer programs, provide a diagnosis that fits with the input information by matching the fingerprint parameters (e.g., levels of the proteins present in the blood as detected using a particular panel or array of the present invention) with a database of fingerprints.

A computer system in accordance with a preferred embodiment of the present invention may be, for example, an enhanced IBM AS/400 mid-range computer system. However, those skilled in the art will appreciate that the methods and apparatus of the present invention apply equally to any computer system, regardless of whether the computer system is a complicated multi-user computing apparatus or a single user device such as a personal computer or workstation. Computer systems suitably comprise a processor, main memory, a memory controller, an auxiliary storage interface, and a terminal interface, all of which are interconnected via a system bus. Note that various modifications, additions, or deletions may be made to the computer system within the scope of the present invention such as the addition of cache memory or other peripheral devices.

The processor performs computation and control functions of the computer system, and comprises a suitable central processing unit (CPU). The processor may comprise a single integrated circuit, such as a microprocessor, or may comprise any suitable number of integrated circuit devices and/or circuit boards working in cooperation to accomplish the functions of a processor.

In a preferred embodiment, the auxiliary storage interface allows the computer system to store and retrieve information from auxiliary storage devices, such as magnetic disk (e.g., hard disks or floppy diskettes) or optical storage devices (e.g., CD-ROM). One suitable storage device is a direct access storage device (DASD). A DASD may be a floppy disk drive that may read programs and data from a floppy disk. It is important to note that while the present invention has been (and will continue to be) described in the context of a fully functional computer system, those skilled in the art will appreciate that the mechanisms of the present invention are capable of being distributed as a program product in a variety of forms, and that the present invention applies equally regardless of the particular type of signal bearing media to actually carry out the distribution. Examples of signal bearing media include: recordable type media such as floppy disks and CD ROMS, and transmission type media such as digital and analog communication links, including wireless communication links.

The computer systems of the present invention may also comprise a memory controller, through use of a separate processor, which is responsible for moving requested information from the main memory and/or through the auxiliary storage interface to the main processor. While for the purposes of explanation, the memory controller is described as a separate entity, those skilled in the art understand that, in practice, portions of the function provided by the memory controller may actually reside in the circuitry associated with the main processor, main memory, and/or the auxiliary storage interface.

Furthermore, the computer systems of the present invention may comprise a terminal interface that allows system administrators and computer programmers to communicate with the computer system, normally through programmable workstations. It should be understood that the present invention applies equally to computer systems having multiple processors and multiple system buses. Similarly, although the system bus of the preferred embodiment is a typical hardwired, multidrop bus, any connection means that supports bidirectional communication in a computer-related environment could be used.

The main memory of the computer systems of the present invention suitably contains one or more computer programs relating to the organ-specific molecular blood fingerprints and an operating system. Computer program is used in its broadest sense, and includes any and all forms of computer programs, including source code, intermediate code, machine code, and any other representation of a computer program. The term "memory" as used herein refers to any storage location in the virtual memory space of the system. It should be understood that portions of the computer program and operating system may be loaded into an instruction cache for the main processor to execute, while other files may well be stored on magnetic or optical disk storage devices. In addition, it is to be understood that the main memory may comprise disparate memory locations.

All of the U.S. patents, U.S. patent application publications, U.S. patent applications, foreign patents, foreign patent applications and non-patent publications referred to in this specification and/or listed in the Application Data Sheet, are incorporated herein by reference, in their entirety. Moreover, all numerical ranges utilized herein explicitly include all integer values within the range and selection of specific numerical values within the range is contemplated depending on the particular use. Further, the following examples are offered by way of illustration, and not by way of limitation.

EXAMPLES

Example 1

Evidence for the Presence of Disease-Perturbed Networks in Prostate Cancer Cells by Genomic and Proteomic Analyses: A Systems Approach to Disease The following example demonstrates the presence of disease-perturbed networks in prostate.

Prostate cancer is the most common nondermatological cancer in the United States (Greenlee, R. T., et al., *CA Cancer J Clin*, 50: 7-33, 2000). Initially, its growth is androgen-dependent (AD); early-stage therapies, including chemical and surgical castration, kill cancerous cells by androgen deprivation. Although such therapies produce tumor regression, they eventually fail because most prostate carcinomas become androgen-independent (AI) (Isaacs, J. T. *Urol Clin North Am*, 26: 263-273, 1999). To improve the efficacy of prostate cancer therapy, it is necessary to understand the molecular mechanisms underlying the transition from androgen dependence to androgen independence.

The transition from AD to AI status likely results from multiple processes, including activation of oncogenes, inactivation of tumor suppressor genes, and changes in key components of signal transduction pathways and gene regulatory networks. Systems approaches to biology and disease are predicated on the identification of the elements of the systems, the delineation of their interactions and their changes in distinct disease states. Biological information is of two types: the digital information of the genome (e.g. genes and cis-control elements) and environmental cues. Proteins rarely act in isolation; rather, they form parts of molecular machines or participate in network interactions mediating cellular functions such as signal transduction and developmental or physiological response patterns. Gene regulatory networks, whose architecture and linkages are established by cis-control elements, integrate information from signal transduction networks and output it to developmental or physiological batteries or networks of effector proteins. Normal protein and gene regulatory networks may be perturbed by disease—through genetic and/or environmental perturbations and understanding these differences lies at the heart of systems approaches to disease. Disease-perturbed networks initiate altered responses that bring about pathologic phenotypes such as the invasiveness of cancer cells.

To map network perturbations in cancer initiation and progression, changes in expression levels of virtually all transcripts must be measured. Certain low-abundance transcripts, such as those encoding transcription factors and signal transducers, wield significant regulatory influences in spite of the fact they may be present in the cell at very low copy numbers. Differential display (Bussemakers, M. J., et al., *Cancer Res*, 59: 5975-5979, 1999) or cDNA microarrays (Vaarala, M. H., et al., *Lab Invest*, 80: 1259-1268, 2000; Chang, G. T., et al., *Cancer Res*, 57: 4075-4081, 1997) have been, used to profile changes in gene expression during the AD to AI transition; however, those technologies can identify only a limited number of more abundant mRNAs, and they miss many low-abundance mRNAs due to their low detection sensitivities. Massively parallel signature sequencing (MPSS), allows 20-nucleotide signature sequences to be determined in parallel for more than 1,000,000 DNA sequences (Brenner, et al., 2000, supra). MPSS technology allows identification and cataloging of almost all mRNAs that are changed between two cell states, even those with one or a few transcripts per cell, or between different organs or tissues. Differentially expressed genes thus identified can be mapped onto cellular networks to provide a systemic understanding of changes in cellular state.

Although transcriptome (mRNA levels) differences are easier to study than proteome (protein levels) differences and provide extremely valuable information, cellular functions are usually performed by proteins. RNA expression profiling studies do not address how the encoded proteins function biologically, and transcript abundance levels do not always correlate with protein abundance levels (Chen, G., et al., *Mol Cell Proteomics*, 1: 304-313, 2002). Therefore, the mRNA expression profiling described herein was complemented with a more limited protein profiling by using isotope-coded affinity tags (ICAT) coupled with tandem mass spectrometry (MS/MS) (Gygi, S. P., et al., *Nat Biotechnol*, 17: 994-999, 1999).

The LNCaP cell line is a widely used androgen-sensitive model for early-stage prostate cancer from which androgen-independent sublines have been generated (Vaarala, M. H., et al., 2000, supra; Chang, G. T., et al., 1997, supra; Patel, B. J., et al., *J Urol*, 164: 1420-1425, 2000). The cells of one such variant, CL-1, in contrast to their LNCaP progenitors, are highly tumorigenic, and exhibit invasive and metastatic characteristics in intact and castrated mice (Patel, G. J., et al., 2000, supra; Tso, C. L., et al., *Cancer J Sci Am*, 6: 220-233, 2000). Thus CL-1 cells model late-stage prostate cancer. MPSS and ICAT data extracted from these model cell lines can be validated by real-time RT-PCR or western blot analysis in more relevant biological models (tumor xenografts) and in tumor biopsies.

An MPSS analysis of about 5 million signatures was conducted for the androgen-dependent LNCaP cell line and its androgen-independent derivative CL1. The resulting database offers the first comprehensive view of the digital transcriptomes of prostate cancer cells and allows exploration of the cellular pathways perturbed during the transition from AD to AI growth. Additionally, protein expression profiles between LNCaP and CL1 cells were compared using ICAT/MS/MS technology. Further, computational analysis was used to identify those proteins that are secreted. Once such protein was further investigated and shown to be a diagnostic marker for prostate cancer used either alone, or in combination with the known PSA prostate cancer marker.

MPSS Analysis:

LNCaP and CL1 cells were grown using methods known in the art, for example, as described by Tso et al. 2000, supra). RNAs were isolated using Trizol (Life Technologies) according to the manufacturer's protocols (see, e.g., as described by Nelson et al. *Proc Natl Acad Sci USA*, 99: 11890-11895, 2002). MPSS cDNA libraries were constructed, individual cDNA sequences were amplified and attached to individual beads and sequenced as described by Brenner, et al., 2000, supra. The resulting signatures, generally 20 bases in length, were annotated using the then most recently annotated human genome sequence (human genome release hg16, released in November, 2003) and the human Unigene (Unigene build #184) according to a previously published method (Meyers, B. C., et al., *Genome Res*, 14: 1641-1653, 2004). Only 100% matches between an MPSS signature and a genome signature were considered. Those signatures that expressed at less than 3 tpm in both LNCaP and CL1 libraries were also excluded, as they might not be reliably detected (this represents less than one transcript per cell) (Jongeneel, C. V., et al., *Proc Natl Acad Sci USA*, 2003). Additionally, cDNA signatures were classified by their positions relative to polyadenylation signals and poly (A) tails and by their orientation relative to the 5'→3' orientation of source mRNA. The Z-test (Man, M. Z., et al., *Bioinformatics*, 16: 953-959, 2000) was used to calculate P values for comparison of gene expression levels between the cell lines.

Isotope-Coded Affinity Tag (ICAT) Analysis:

ICAT reagents were purchased from Applied Biosystems Inc. Fractionation of cells into cytosolic, microsomal and nuclear fractions, as well as ICAT labeling, MS/MS, and data analyses were performed as described by Han et al. *Nat Biotechnol*, 19: 946-951, 2001. In addition, probability score analysis (Keller, A., et al., *Anal Chem*, 74: 5383-5392, 2002) and ASAPRatio (Automated Statistical Analysis on Protein Ratio) (Li, X. J., et al., *Anal Chem*, 75: 6648-6657, 2003) were used to assess the quality of MS spectra and to calculate protein ratios from multiple peptide ratios. (Briefly, and as described at http colon double slash regis dot systemsbiology dot net/software, Automated Statistical Analysis on Protein Ratio (ASAPRatio) accurately calculates the relative abundances of proteins and the corresponding confidence intervals from ICAT-type ESI-LC/MS data. The software first uses a Savitzky-Golay smoothing filter to reconstruct LC spectra of a peptide and its partner in a single charge state, subtracts background noise from each spectrum, and calculates light: heavy ratio of the peptide in that charge state. The ratios of the same peptide in different charge states are averaged and weighted by the corresponding spectrum intensity to obtain the peptide light:heavy ratio and its error. Subsequently, all unique peptides identified for a given protein are collected, their ratios and errors calculated, outliers are checked for using Dixon's tests, and the relative abundance and confidence interval for the protein are calculated by applying statistics for weighed samples. The software quickly generates a list of interesting proteins based on their relative abundance. A byproduct of the software is to identify outlier peptides which may be misidentified or, more interestingly, post-translationally modified.) To compare protein and mRNA expression levels, the Unigene numbers of the differentially expressed proteins were used to find MPSS signatures and their expression levels in transcripts per million (tpm). If one Unigene had more than one MPSS signature, likely due to alternative terminations, the average tpm of all signatures was taken.

Real-Time RT-PCR:

All primers were designed with the PRIMER3 program (httpcolon double slash www-genome dot wi dot mit dot edu slash cgi-bin slash primer slash primer3_www dot cgi) and BLAST-searched against the human cDNA and EST database for uniqueness. Real-time PCR was performed on an ABI 7700 machine (PE Biosystems) and the SYBR Green dye (Molecular Probe Inc.) was used as a reporter. PCR conditions were designed to give bands of the expected size with minimal primer dimer bands.

Identification of Perturbed Networks:

Genes in the 328 Biocarta and Kyoto Encyclopedia of Genes and Genomes (KEGG) pathways or networks (http colon double slash cgap dot nci dot nih dot gov slash Pathways slash) were downloaded and compared with the MPSS data, using Unigene IDs as identifiers. If a Unigene ID or an E.C. number corresponded to multiple signatures, potentially due to multiple alternatively terminated isoforms, the tpm counts of the isoforms were combined and then subjected to the Z-test (Man, M. Z., et al., 2000, supra). Genes with P values of 0.001 or less were considered to be significantly differentially expressed. The following criteria were used to identify perturbed networks: a perturbed network must have more than 3 genes represented our differentially expressed gene list (p<0.001) and at least 50% of those genes must be up regulated, it was considered an up-regulated pathway (vice versa for the down-regulated pathways).

Display of KEGG Networks by Cytoscape:

Cytoscape software was used (www dot cytoscape dot org) (Shannon, P., et al., *Genome Res*, 13: 2498-2504, 2003), to map the data onto the web of intracellular molecular interactions. We imported metabolic network maps and related information such as enzymes, substrates, and reactions from the recently developed KEGG (http colon double slash www dot genome dot ad dot jp slash) API 2.0 web server into the Cytoscape program. Expression data were thus automatically mapped to the KEGG and Biocarta pathways/networks and visualized by Cytoscape.

MPSS Analyses of the Androgen-Dependent LNCaP Cell Line and its Androgen-Independent Variant CL1:

Using MPSS technology, 2.22 million signature sequences were sequenced for LNCaP cells and 2.96 million for CL1 cells.

A total of 19,595 unique transcript signatures expressed at levels >3 tpm in at least one of the samples were identified. The signatures were classified into three major categories: 1093 signatures matched repeat sequences; 15,541 signatures matched unique cDNAs or ESTs, and 2961 signatures had no matches to any cDNA or EST sequences (but did match genomic sequences). The last category included sequences falling into one of three different categories: signatures representing new transcripts yet to be defined, signatures representing polymorphisms in cDNA sequences (a match of an MPSS sequence to cDNA or EST sequences requires 100% sequence identity), or errors in the MPSS reads. Transcript tags with matches to a cDNA or EST sequence were further classified based on the signatures' relative orientation to transcription direction and their position relative to a polyadenylation site and/or poly(A) tail. A searchable MySQL database (www dot mysql dot com) was also built containing the expression levels (tpm), the genomic locations of the MPSS sequences, the cDNAs or EST matches, and the classification of each signature.

The first analysis was restricted to those MPSS signatures corresponding to cDNAs with poly(A) tails and/or polyadenylation sites, so that corresponding genes could be conclusively identified. The Z-test was used to compare differential gene expression between LNCaP cells and CL1 cells (Mann, et al., 2000, supra). Using very stringent P values (less than 0.001), 2088 MPSS signatures were identified (corresponding to 1987 unique genes, as some genes have two or more MPSS signatures, due to alternative usages of polyadenylation sites) with significant differential expression. Of these, 1011 signatures (965 genes) were overexpressed in CL1 cells, and 1077 signatures (1022 genes) were overexpressed in LNCaP cells. The significance score of Z-test was dependent on the expression level. If a cut off P value of less than 0.001 was taken in the dataset, the expression level in tpm changed from 0 to 26 tpm for the most lowly expressed transcript (>26 fold); and changed from 7591 and 11206 tpm for the most highly expressed transcript (1.48 fold).

The expression levels of nine randomly chosen genes were identified using the MPSS and quantitative real-time RT-PCR techniques and showed that both RNA data sets were concordant. The MPSS expression profiling data were consistent with the available published data. For example, using RT-PCR, Patel et al. (Patel, B. J., et al., *J Urol,* 164: 1420-1425, 2000) showed that CL1 tumors express barely detectable prostate-specific antigen (PSA) and androgen receptor (AR) mRNAs as compared with LNCaP cells. The present MPSS results indicated that LNCaP cells expressed 584 tpm of androgen receptor (AR) and 841 tpm of PSA; CL1 cells did not express either AR or PSA (0 tpm in both cases). Freedland et al. found that CD10 expression was lost in CL1 cells compared with LNCaP cells (Freedland, S. J., et al., *Prostate,* 55: 71-80, 2003); the present study found that CD10 was expressed at 0 tpm in CL1 cells but at 56 tpm in LNCaP cells. Using cDNA microarrays, Vaarala et al. (Vaarala, M. H., et al., *Lab Invest,* 80: 1259-1268, 2000) compared LNCaP cells and another androgen-independent variant, non-PSA-producing LNCaP line, which is similar to CL1, and identified a total of 56 differentially expressed genes. We found completely concordant expression changes in these 56 genes between LNCaP and CL1 (in contrast to 1987 found by MPSS), and between LNCaP and non-PSA-producing LNCaP cells. This underscores the striking differences in sensitivity between the MPSS and cDNA microarray techniques.

CL1 cells do not express AR and thus lack the AR-mediated response program. To distinguish androgen response from other programs contributing to prostate cancer progression, the list of genes differentially expressed between LNCaP and CL1 cells were compared with a complementary list derived from MPSS analysis of LNCaP cells grown in the presence or absence of androgens (LNCaP R+/R−). From the 1987 differentially expressed gene between LNCaP and CL1, 525 genes were identified that were also differentially expressed in the LNCaP R+/R− dataset. Differential expression of these genes between LNCaP and CL1 cells probably reflects the fact that LNCaP cells express AR but CL1 does not, and the fact that normal medium contains some androgen. The remaining 1462 differentially expressed genes were not directly related to cellular AR status.

To compare the sensitivity of the MPSS and cDNA microarray procedures, cDNA microarrays containing 40,000 human cDNAs were hybridized to the same LNCaP and CL1 RNAs that were used for MPSS. Three replicate array hybridizations were performed. MPSS signatures and array clone IDs were mapped to Unigene IDs for data extraction and comparisons. The results showed that only those genes expressed at >40 tpm by MPSS could be reliably detected as changing levels by cDNA microarray hybridizations [judged by an expression level twice the standard deviation of the background, a standard cutoff value for microarray data analysis]. This observation is consistent with the 33-60 tpm sensitivity of microarrays estimated from the experiment performed by Hill et al. Science, 290: 809-812, 2000, in which known concentrations of synthetic transcripts were added. In LNCaP and CL1 cells, about 68.75% (13,471 of 19,595) of MPSS signatures (>3 tpm) were expressed at a level below 40 tpm; changes in the levels of these genes will be missed by microarray methods. Many attempts have been made to increase the sensitivity of DNA array technology (Han, M., et al., *Nat Biotechnol,* 19: 631-635, 2001; Bao, P., et al., *Anal Chem,* 74: 1792-1797, 2002.), however, the present study has not compared these new improvements against MPSS but it is clear that there will still be significant differences in the levels of change that can be detected.

SAGE (serial analysis of gene expression) (Velculescu, V. E., et al., *Trends Genet,* 16: 423-425, 2000) is another technology for gene expression profiling; like MPSS, it is digital and can generate a large number of signature sequences. However, MPSS, which can sequence ~1 million signatures per sample, can achieve a much deeper coverage than SAGE (typical ~10,000-100,000 signatures sequenced/sample) at reasonable cost. The MPSS data on LNCaP cells was compared against publicly available SAGE data on LNCaP cells (NCBI SAGE database) through common Unigene IDs. The SAGE library GSM724 (total SAGE tags sequenced: 22,721) (Lal, A., et al., *Cancer Res,* 59: 5403-5407, 1999) was derived from LNCaP cells with an inactivated PTEN gene; it is the SAGE library most similar to the LNCaP cells. Only 400 (about 20%) of the 1987 significantly differentially expressed genes (P<0.001) had any SAGE tag entry in GSM724. These data illustrate the importance of deep sequence coverage in identifying state changes in transcripts expressed at low abundance levels.

Functional Classifications of Genes Differentially Expressed Between LNCaP and CL1 Cells:

Examination of the GO (Gene Ontology) classification of the 1987 genes revealed that multiple cellular processes change during the transition from LNCaP cells to CL1 cells. The most interesting groups, categorized by function, are shown in Table 1.

Nineteen differentially expressed proteins are related to apoptosis. Twelve of these are up regulated in CL1 cells, including the apoptosis inhibitors Taxi (human T-cell leukemia virus type I) binding protein 1 (TAX1BP1) and CASP8 and FADD-like apoptosis regulator. Seven are down regulated in CL1, including programmed cell death 8 and 5 (apoptosis-inducing factors), and BCL2-like 13 (an apoptosis facilitator). Since CL1 cells have increased expression of apoptosis inhibitors and decreased expression of apoptosis inducers, net inhibition of apoptosis may contribute to their greater tumorigenicity.

TABLE 1

EXAMPLES OF DIFFERENTIALLY EXPRESSED GENES AND THEIR FUNCTIONAL CLASSIFICATIONS

| Signatures | LNCaP (tpm) | CL1 (tpm) | Description | GenBank ID | SEQ ID NOS: |
|---|---|---|---|---|---|
| Apoptosis related | | | | | |
| GATCAAATGTGTGGCCT (SEQ ID NO: 3) | 0 | 3609 | lectin, galactoside- | BC001693 | 1574-1575 |

TABLE 1-continued

EXAMPLES OF DIFFERENTIALLY EXPRESSED GENES
AND THEIR FUNCTIONAL CLASSIFICATIONS

| Signatures | LNCaP (tpm) | CL1 (tpm) | Description | GenBank ID | SEQ ID NOS: |
|---|---|---|---|---|---|
| GATCATAATGTTAACTA (SEQ ID NO: 4) | 0 | 14 | binding, soluble, 1 (galectin 1), pleiomorphic adenoma gene-like 1 (PLAGL1) | NM_002656 | 1576-1577 |
| GATCATCCAGAGGAGCT (SEQ ID NO: 5) | 0 | 16 | caspase 7, apoptosis-related cysteine protease | U40281 | 1578-1579 |
| GATCGCGGTATTAAATC (SEQ ID NO: 6) | 0 | 15 | tumor necrosis factor receptor superfamily, member 12 | U75380 | 1580-1581 |
| GATCTCCTGTCCATCAG (SEQ ID NO: 7) | 0 | 24 | interleukin 1, beta | M15330 | 1582-1583 |
| GATCCCCTTCAAGGACA (SEQ ID NO: 8) | 1 | 19 | nudix (nucleoside diphosphate linked moiety X)-type motif 1 | NM_006024 | 1584-1585 |
| GATCATTGCCATCACCA (SEQ ID NO: 9) | 51 | 278 | EST, Highly similar to CUL2_HUMAN CULLIN HOMOLOG 2 | AL832733 | 1586 |
| GATCTGAAAATTCTTGG (SEQ ID NO: 10) | 16 | 56 | CASP8 and FADD-like apoptosis regulator | U97075 | r587-1588 |
| GATCCACCTTGGCCTCC (SEQ ID NO: 11) | 49 | 149 | tumor necrosis factor receptor superfamily, member 10b | NM_003842 | 1589-1590 |
| GATCATGAATGACTGAC (SEQ ID NO: 12) | 118 | 257 | cytochrome c | BC009582 | 1591-1592 |
| GATCAAGTCCTTTGTGA (SEQ ID NO: 13) | 299 | 102 | programmed cell death 8 (apoptosis-inducing factor) | H20713 | 1593 |
| GATCACCAAAACCTGAT (SEQ ID NO: 14) | 72 | 24 | BCL2-like 13 (apoptosis facilitator) | BM904887 | 1594 |
| GATCAATCTGAACTATC (SEQ ID NO: 15) | 563 | 146 | apoptosis related protein APR-3 (APR-3) | NM_016085 | 1595-1596 |
| GATCCCTCTGTACAGGC (SEQ ID NO: 16) | 83 | 13 | unc-13-like (C. elegans) (UNC13), mRNA. | NM_006377 | 1597-1598 |
| GATCTGGTTGAAAATTG (SEQ ID NO: 17) | 1006 | 49 | CED-6 protein (CED-6), mRNA. | NM_016315 | 1599-1600 |
| GATCTCCCATGTTGGCT (SEQ ID NO: 18) | 86 | 4 | CASP2 and RIPK1 domain containing adaptor with death domain | BC017042 | 1601-1602 |
| GATCAGAAAATCCCTCT (SEQ ID NO: 19) | 27 | 1 | DEAD/H (Asp-Glu-Ala-Asp/His) box polypeptide 20, 103 kDa | BC011556 | 1603-1604 |
| GATCAAGGATGAAAGCT (SEQ ID NO: 20) | 50 | 3 | programmed cell death 2 | D20426 | 1605 |
| GATCTGATTATTTACTT (SEQ ID NO: 21) | 1227 | 321 | programmed cell death 5 | NM_004708 | 1606-1607 |
| GATCAAGTCCTTTGTGA (SEQ ID NO: 22) | 299 | 102 | programmed cell death 8 (apoptosis-inducing factor) | NM_004208 | 1608-1609 |

TABLE 1-continued

EXAMPLES OF DIFFERENTIALLY EXPRESSED GENES
AND THEIR FUNCTIONAL CLASSIFICATIONS

| Signatures | LNCaP (tpm) | CL1 (tpm) | Description | GenBank ID | SEQ ID NOS: |
|---|---|---|---|---|---|
| Cyclins | | | | | |
| GATCCTGTCAAAATAGT (SEQ ID NO: 23) | 2 | 47 | MCT-1 protein (MCT-1), mRNA. | NM_014060 | 1610-1611 |
| GATCATTATATCATTGG (SEQ ID NO: 24) | 3 | 39 | cyclin-dependent kinase inhibitor 2B(CDKN2B) | NM_078487 | 1612-1613 |
| GATCATCAGTCACCGAA (SEQ ID NO: 25) | 38 | 396 | cyclin-dependent kinase inhibitor 2A (p16) | BM054921 | 1614 |
| GATCGGGGGCGTAGCAT (SEQ ID NO: 26) | 5 | 43 | cyclin D1 | NM_053056 | 1615-1616 |
| GATCTACTCTGTATGGG (SEQ ID NO: 27) | 40 | 144 | cyclin fold protein 1 | BG119256 | 1617 |
| GATCAGCACTCTACCAC (SEQ ID NO: 28) | 530 | 258 | cyclin B1 | BM973693 | 1618 |
| GATCTGGTGTAGTATAT (SEQ ID NO: 29) | 210 | 77 | cyclin G2 | BM984551 | 1619 |
| GATCAGTACACAATGAA (SEQ ID NO: 30) | 642 | 224 | cyclin G1, | BC000196 | 1620-1621 |
| GATCTCAGTTCTGCGTT (SEQ ID NO: 31) | 918 | 308 | CDK2-associated protein 1 (CDK2AP1), mRNA. | NM_004642 | 1622-1623 |
| GATCCTGAGCTCCCTTT (SEQ ID NO: 32) | 2490 | 650 | cyclin I, | BC000420 | 1624-1625 |
| GATCATGCAGTGACATA (SEQ ID NO: 33) | 15 | 1 | KIAA1028 protein | AL122055 | 1626-1627 |
| GATCTGTATGTGATTGG (SEQ ID NO: 34) | 28 | 1 | cyclin M3 | AA489077 | 1628 |
| Kallikreins | | | | | |
| GATCCACACTGAGAGAG (SEQ ID NO: 35) | 841 | 0 | KLK3 | AA523902 | 1629 |
| GATCCAGAAATAAAGTC (SEQ ID NO: 36) | 385 | 0 | KLK4 | AA595489 | 1630 |
| GATCCTCCTATGTTGTT (SEQ ID NO: 37) | 314 | 0 | KLK2 | S39329 | 1631-1633 |
| CD markers | | | | | |
| GATCAGAGAAGATGATA (SEQ ID NO: 38) | 0 | 810 | CD213a2, interleukin 13 receptor, alpha 2 | U70981 | 1634-1635 |
| GATCCCTAGGTCTTGGG (SEQ ID NO: 39) | 23 | 161 | CD213a1, interleukin 13 receptor, alpha 1 | AW874023 | 1636 |
| GATCCACATCCTCTACA (SEQ ID NO: 40) | 0 | 63 | CD33,CD33 antigen (gp67) | BC028152 | 1637-1638 |
| GATCAATAATAATGAGG (SEQ ID NO:41) | 0 | 151 | CD44,CD44 antigen | AL832642 | 1639-1640 |
| GATCCTTCAGCCTTCAG (SEQ ID NO: 42) | 0 | 35 | CD73,5'-nucleotidase, ecto (CD73) | AI831695 | 1641 |
| GATCTGGAACCTCAGCC (SEQ ID NO: 43) | 1 | 50 | CD49e, integrin, alpha 5 | BC008786 | 1642-1643 |
| GATCAGAGATGCACCAC (SEQ ID NO: 44) | 8 | 122 | CD138, syndecan 1 | BM974052 | 1644 |
| GATCAAAGGTTTAAAGT (SEQ ID NO: 45) | 38 | 189 | CD166, activated leukocyte cell adhesion molecule | AL833702 | 1645 |
| GATCAGCTGTTTGTCAT (SEQ ID NO: 46) | 53 | 295 | CD71, transferrin receptor (p90, CD71) | BC001188 | 1646-1647 |

TABLE 1-continued

EXAMPLES OF DIFFERENTIALLY EXPRESSED GENES
AND THEIR FUNCTIONAL CLASSIFICATIONS

| Signatures | LNCaP (tpm) | CL1 (tpm) | Description | GenBank ID | SEQ ID NOS: |
|---|---|---|---|---|---|
| GATCGGTGCGTTCTCCT (SEQ ID NO: 47) | 287 | 509 | CD107a, lysosomal-associated membrane protein 1 | AI521424 | 1648 |
| GATCTACAAAGGCCATG (SEQ ID NO: 48) | 161 | 681 | CD29, integrin, beta 1 | NM_002211 | 1649-1650 |
| GATCATTTATTTTAAGC (SEQ ID NO: 49) | 56 | 0 | CD10 (neutral endopeptidase, enkephalinase) | BQ013520 | 1651 |
| GATCAGTCTTTATTAAT (SEQ ID NO: 50) | 150 | 50 | CD107b, lysosomal-associated membrane protein 2 | AI459107 | 1652 |
| GATCTTGGCTGTATTTA (SEQ ID NO: 51) | 84 | 1014 | CD59 antigen p18-20 | NM_000611 | 1653-1654 |
| GATCTTGTGCTGTGCTA (SEQ ID NO: 52) | 408 | 234 | CD9 antigen (p24) | NM_001769 | 1655-1656 |
| Transcription factors | | | | | |
| GATCAAATAACAAGTCT (SEQ ID NO: 53) | 0 | 62 | transcription factor BMAL2 | BM854818 | 1657 |
| GATCTCTATGTTTACIT (SEQ ID NO: 54) | 0 | 27 | transcription factor BMAL2 | BG163364 | 1658 |
| GATCCTGACACATAAGA (SEQ ID NO: 55) | 12 | 74 | transcription factor BMAL2 | BF055294 | 1659 |
| GATCATTTTGTATTAAT (SEQ ID NO: 56) | 10 | 61 | transcription factor NRF | BC047878 | 1660-1661 |
| GATCGTCTCATATTTGC (SEQ ID NO: 57) | 52 | 0 | transcriptional coactivator tubedown-100 | NM_025085 | 1662-1663 |
| GATCCCCCTCTTCAATG (SEQ ID NO: 58) | 0 | 31 | transcriptional co-activator with PDZ-binding motif | AJ299431 | 1664-1665 |
| GATCAAATGCTATTGCA (SEQ ID NO: 59) | 1 | 55 | transcriptional regulator interacting with the PHS-bromodomain 2 | AI126500 | 1666 |
| GATCTGTGACAGCAGCA (SEQ ID NO: 60) | 140 | 35 | transducer of ERBB2, 1 | BC031406 | 1667-1668 |
| GATCAAATCTGTACAGT (SEQ ID NO: 61) | 239 | 23 | transducer of ERBB2, 2 | AA694240 | 1669 |
| Annexins and their ligands | | | | | |
| GATCCTGTGCAACAAGA (SEQ ID NO: 62) | 0 | 69 | annexin A10 | BC007320 | 1670-1671 |
| GATCTGTGGTGGCAATG (SEQ ID NO: 63) | 41 | 630 | annexin A11 | AL576782 | 1672 |
| GATCAGAATCATGGTCT (SEQ ID NO: 64) | 0 | 1079 | annexin A2 | BC001388 | 1673-1674 |
| GATCTCTTTGACTGCTG (SEQ ID NO: 65) | 210 | 860 | annexin A5 | BC001429 | 1675-1676 |
| GATCCAAAAACATCCTG (SEQ ID NO: 66) | 83 | 241 | annexin A6 | AI566871 | 1677 |
| GATCAGAAGACTTTAAT (SEQ ID NO: 67) | 0 | 695 | annexin Al | BC001275 | 1678-1679 |
| GATCAGGACACTTAGCA (SEQ ID NO:68) | 0 | 2949 | S100 calcium binding protein A10 (annexin II ligand) | BC015973 | 1680-1681 |
| Matrix metalloproteinase | | | | | |
| GATCATCACAGTTTGAG (SEQ ID NO: 69) | 0 | 38 | matrix metalloproteinase 10 (stromelysin 2) | BC002591 | 1682-1683 |
| GATCCCAGAGAGCAGCT (SEQ ID NO: 70) | 0 | 108 | matrix metalloproteinase 1 (interstitial collagenase) | BC013118 | 1684-1685 |

TABLE 1-continued

EXAMPLES OF DIFFERENTIALLY EXPRESSED GENES AND THEIR FUNCTIONAL CLASSIFICATIONS

| Signatures | LNCaP (tpm) | CL1 (tpm) | Description | GenBank ID | SEQ ID NOS: |
|---|---|---|---|---|---|
| GATCGGCCATCAAGGGA (SEQ ID NO: 71) | 0 | 25 | matrix metalloproteinase 13 (collagenase 3) | AI370581 | 1686 |
| GATCTGGACCAGAGACA (SEQ ID NO: 72) | 0 | 10 | matrix metalloproteinase 2 (gelatinase A) | BG332150 | 1687 |

Matrix metalloproteinases (MMPs), which degrade extracellular matrix components that physically impede cell migration, are implicated in tumor cell growth, invasion, and metastasis. MMP1, 2, 10 and 13 were found to be significantly overexpressed in CL1 cells (Table 1), which may partially explain these cells' aggressive and metastatic behavior.

CD (cluster designation of monoclonal antibodies) markers are generally localized at the cell surface; some may be associated with prostate cancer (Liu, A. Y., et al., *Prostate*, 40: 192-199, 1999). All currently identified CD markers (CD1 to CD247) from the PROW CD index database (www dot ncbi dot nlm dot nih dot govslash prow slash guide slash 45277084 dot htm) were converted to UniGene numbers and the Unigene numbers used to identify their signatures and their expression levels. Fifteen CD markers were identified that were differentially expressed between LNCaP and CL1 cells (Z score <0.001) (Table 1). Eleven CD markers, including CD213a2 and CD213a1, which encode IL-13 receptors alpha 1 and 2, are up regulated in CL1 cells; three CD markers, CD9, CD10, and CD107, WERE downregulated in these cells (Table 1). Six CD markers went from 0 or 1 tpm to >35 tpm (Table 1), making them good digital or absolute markers or therapeutic targets. These data suggest that carefully selected CD markers may be useful in following the progression of prostate cancer, and indeed could serve as potential targets for antibody-mediated therapies (Liu, A. Y., et al., *Prostate*, 40: 192-199, 1999).

Delineation of Disease-Perturbed Networks in Prostate Cancer Cells.

Genes and proteins rarely act alone but rather generally operate in networks of interactions. Identifying key nodes (proteins) in the disease-perturbed networks may provide insights into effective drug targets. Comparing the genes (proteins) currently available in the 314 BioCarta and 155 KEGG pathway or network (http colon double slash cgap dot nci dot nih dot gov slash Pathways slash) databases with the MPSS data through Unigene IDs, we identified 37 BioCarta and 14 KEGG pathways that are up regulated and 23 BioCarta and 22 KEGG pathways down regulated in LNCaP cells versus CL1 cells (Table 2). The number of genes whose expression patterns changed in each pathway is listed in Table 2. Each gene along with its expression level in LNCaP and CL1 cells is listed pathway by pathway in our database (ftp colon double slash ftp dot systemsbiology dot net slash blin slash mpss). Changes in these pathways reveal the underlying phenotypic differences between LNCaP and CL1 cells. For example, multiple networks involved in modulating cell mobility, adhesion and spreading are up regulated in CL1 cells, which are more metastatic and invasive than LNCaP cells (Table 2). In the uCalpain and Friends in Cell Spread pathway, calpains are calcium-dependent thiol proteases implicated in cytoskeletal rearrangements and cell migration. During cell migration, calpain cleaves target proteins such as talin, ezrin, and paxillin at the leading edge of the membrane, while at the same time cleaving the cytoplasmic tails of the integrins β1(a) and β3(b) to release adhesion attachments at the trailing membrane edge. Increased activity of calpains increases migration rates and facilitates cell invasiveness (Liu, A. et al., Prostate, 40: 192-199, 1999).

TABLE 2

PATHWAYS THAT ARE UP OR DOWN REGULATED COMPARING LNCAP TO CL1 CELLS.

| Pathways | # Genes hits in a pathway | # p < 0.001 & LNCA > CL1 | # p < 0.001 & LNCA < CL1 | # no change |
|---|---|---|---|---|
| Up-regulated Pathways in LNCAP cells | | | | |
| BioCarta Pathways | | | | |
| Mechanism of Gene Regulation by Peroxisome Proliferators via PPARa alpha | 35 | 9 | 2 | 24 |
| T Cell Receptor Signaling Pathway | 21 | 6 | 2 | 13 |
| ATM Signaling Pathway | 15 | 5 | 2 | 8 |
| CARM1 and Regulation of the Estrogen Receptor | 18 | 5 | 2 | 11 |
| HIV-I Nef negative effector of Fas and TNF | 33 | 5 | 2 | 26 |
| EGF Signaling Pathway | 17 | 5 | 1 | 11 |
| Role of BRCA1 BRCA2 and ATR in Cancer Susceptibility | 16 | 5 | 1 | 10 |

TABLE 2-continued

PATHWAYS THAT ARE UP OR DOWN REGULATED COMPARING LNCAP TO CL1 CELLS.

| Pathways | # Genes hits in a pathway | # p < 0.001 & LNCA > CL1 | # p < 0.001 & LNCA < CL1 | # no change |
|---|---|---|---|---|
| TNFR1 Signaling Pathway | 17 | 5 | 1 | 11 |
| Toll-Like Receptor Pathway | 17 | 5 | 1 | 11 |
| FAS signaling pathway CD95 | 17 | 4 | 1 | 12 |
| VEGF Hypoxia and Angiogenesis | 16 | 4 | 1 | 11 |
| Bone Remodelling | 9 | 3 | 1 | 5 |
| ER associated degradation ERAD Pathway | 11 | 3 | 1 | 7 |
| Estrogen-responsive protein Efp controls cell cycle and breast tumors growth | 11 | 3 | 1 | 7 |
| Influence of Ras and Rho proteins on G1 to S Transition | 16 | 3 | 1 | 12 |
| Inhibition of Cellular Proliferation by Gleevec | 13 | 3 | 1 | 9 |
| Map Kinase Inactivation of SMRT Corepressor | 9 | 3 | 1 | 5 |
| NFkB activation by Nontypeable Hemophilus influenzae | 16 | 3 | 1 | 12 |
| RB Tumor Suppressor Checkpoint Signaling in response to DNA damage | 10 | 3 | 1 | 6 |
| Transcription Regulation by Methyltransferase of CARM1 | 10 | 3 | 1 | 6 |
| Ceramide Signaling Pathway | 13 | 4 | 0 | 9 |
| Cystic fibrosis transmembrane conductance regulator and beta 2 adrenergic receptor pathway | 7 | 4 | 0 | 3 |
| Nerve growth factor pathway NGF | 11 | 4 | | |
| PDGF Signaling Pathway | 16 | 4 | 0 | 12 |
| TNF Stress Related Signaling | 14 | 4 | 0 | 10 |
| Activation of Csk by cAMP-dependent Protein Kinase Inhibits Signaling through the T Cell Receptor | 9 | 3 | 0 | 6 |
| AKAP95 role in mitosis and chromosome dynamics | 11 | 3 | 0 | 8 |
| Attenuation of GPCR Signaling | 7 | 3 | 0 | 4 |
| Chaperones modulate interferon Signaling Pathway | 11 | 3 | 0 | 8 |
| ChREBP regulation by carbohydrates and cAMP | 12 | 3 | 0 | 9 |
| IGF-1 Signaling Pathway | 11 | 3 | 0 | 8 |
| Insulin Signaling Pathway | 11 | 3 | 0 | 8 |
| NF-kB Signaling Pathway | 11 | 3 | 0 | 8 |
| Protein Kinase A at the Centrosome | 12 | 3 | 0 | 9 |
| Regulation of ck1 cdk5 by type 1 glutamate receptors | 10 | 3 | 0 | 7 |
| Role of Mitochondria in Apoptotic Signaling | 10 | 3 | 0 | 7 |
| Signal transduction through IL1R | 14 | 3 | 0 | 11 |
| KEGG Pathways | | | | |
| Aminosugars metabolism | 24 | 9 | 4 | 11 |
| Androgen and estrogen metabolism | 37 | 13 | 5 | 19 |
| Benzoate degradation via hydroxylation | 5 | 3 | 1 | |
| C21-Steroid hormone metabolism | 4 | 1 | 0 | |
| CS-Branched dibasic acid metabolism | 2 | 2 | 0 | 0 |
| Carbazole degradation | 1 | 1 | 0 | 0 |
| Terpenoid biosynthesis | 6 | 4 | 1 | 1 |
| Chondroitin_heparan sulfate biosynthesis | 14 | 8 | 3 | 3 |
| Fatty acid biosynthesis (path 1) | 3 | 2 | 0 | 1 |
| Fluorene degradation | 3 | 2 | 0 | |
| Pentose and glucuronate interconversions | 19 | 9 | 1 | 9 |

TABLE 2-continued

PATHWAYS THAT ARE UP OR DOWN REGULATED COMPARING LNCAP TO CL1 CELLS.

| Pathways | # Genes hits in a pathway | # p < 0.001 & LNCA > CL1 | # p < 0.001 & LNCA < CL1 | # no change |
|---|---|---|---|---|
| Phenylalanine, tyrosine and tryptophan biosynthesis | 10 | 5 | 2 | 3 |
| Porphyrin and chlorophyll metabolism | 28 | 13 | 3 | 12 |
| Streptomycin biosynthesis | 6 | 4 | 1 | 1 |
| Up-regulated Pathways in CL1 cells | | | | |
| BioCarta Pathways | | | | |
| Rho cell motility signaling pathway | 18 | 2 | 6 | 10 |
| Trefoil Factors Initiate Mucosal Healing | 14 | 1 | 6 | 7 |
| Integrin Signaling Pathway | 14 | 1 | 5 | 8 |
| Ca Calmodulin-dependent Protein Kinase Activation | 7 | 1 | 4 | 2 |
| Effects of calcineurin in Keratinocyte Differentiation | 9 | 1 | 4 | 4 |
| Angiotensin II mediated activation of JNK Pathway via Pyk2 dependent signaling | 12 | 1 | 3 | 8 |
| Bioactive Peptide Induced Signaling Pathway | 16 | 1 | 3 | 12 |
| CBL mediated ligand-induced downregulation of EGF receptors | 6 | 1 | 3 | 2 |
| Control of skeletal myogenesis by HDAC calcium calmodulin-dependent kinase CaMK | 12 | 1 | 3 | 8 |
| How does salmonella hijack a cell | 8 | 1 | 3 | 4 |
| Melanocyte Development and Pigmentation Pathway | 4 | 1 | 3 | 0 |
| Overview of telomerase protein component gene hTert Transcriptional Regulation | 7 | 1 | 3 | 3 |
| Regulation of PGC-1a | 9 | 0 | 4 | 5 |
| ADP-Ribosylation Factor | 9 | 0 | 3 | 6 |
| Downregulated of MTA-3 in ER-negative Breast Tumors | 7 | 0 | 3 | 4 |
| Endocytotic role of NDK Phosphins and Dynamin | 7 | 0 | 3 | 4 |
| Mechanism of Protein Import into the Nucleus | 7 | 0 | 3 | 4 |
| Nuclear Receptors in Lipid Metabolism and Toxicity | 7 | 0 | 3 | 4 |
| Pertussis toxin-insensitive CCR5 Signaling in Macrophage | 9 | 0 | 3 | 6 |
| Platelet Amyloid Precursor Protein Pathway | 5 | 0 | 3 | 2 |
| Role of Ran in mitotic spindle regulation | 8 | 0 | 3 | 5 |
| Sumoylation by RanBP2 Regulates Transcriptional Repression | 8 | 0 | 3 | 5 |
| uCalpain and friends in Cell spread | 5 | 0 | 3 | 2 |
| KEGG Pathways | | | | |
| Arginine and proline metabolism | 45 | 7 | 16 | 22 |
| ATP synthesis | 31 | 7 | 15 | 9 |
| Biotin metabolism | 5 | 1 | 3 | 1 |
| Blood group glycolipid biosynthesis - lactoseries | 12 | 1 | 6 | 5 |
| Cyanoamino acid metabolism | 5 | 0 | 3 | 2 |
| Ethylbenzene degradation | 9 | 1 | 3 | 5 |
| Ganglioside biosynthesis | 16 | 2 | 6 | 8 |
| Globoside metabolism | 17 | 3 | 8 | 6 |
| Glutathione metabolism | 26 | 4 | 10 | 12 |
| Glycine, serine and threonine metabolism | 32 | 6 | 14 | 12 |

TABLE 2-continued

PATHWAYS THAT ARE UP OR DOWN REGULATED COMPARING LNCAP TO CL1 CELLS.

| Pathways | # Genes hits in a pathway | # p < 0.001 & LNCA > CL1 | # p < 0.001 & LNCA < CL1 | # no change |
|---|---|---|---|---|
| Glycosphingolipid metabolism | 35 | 6 | 18 | 11 |
| Glycosylphosphatidylinositol (GPI)-anchor biosynthesis | 26 | 5 | 12 | 9 |
| Glyoxylate and dicarboxylate metabolism | 9 | 1 | 6 | 2 |
| Huntington's disease | 25 | 4 | 10 | 11 |
| Methane metabolism | 9 | 1 | 3 | 5 |
| O-Glycans biosynthesis | 19 | 3 | 8 | 8 |
| One carbon pool by folate | 12 | 2 | 8 | 2 |
| Oxidative phosphorylation | 93 | 21 | 45 | 27 |
| Parkinson's disease | 30 | 5 | 14 | 11 |
| Phospholipid degradation | 21 | 4 | 12 | 5 |
| Synthesis and degradation of ketone bodies | 7 | 1 | 3 | 3 |
| Urea cycle and metabolism of amino groups | 18 | 2 | 8 | 8 |

Many pathways we identified as perturbed in the LNCaP and CL1 comparison are interconnected to form networks (in fact there are probably no discrete pathways, only networks). For example, the insulin signaling pathway, the signal transduction through IL1R pathway, NF-kB signaling pathway are interconnected through c-Jun, IL1R and NF-kB. The mapping of genes onto networks/pathways will be an ongoing objective as more networks/pathways become available. Our transcriptome data will be an invaluable resource in delineating these relationships.

As gene regulatory networks controlled by transcription factors form the top layer of the hierarchy that controls the physiological network, we sought to identify differentially expressed transcription factors. Of 554 transcription factors expressed in LNCaP and CL1 cells, 112 showed significantly different levels between the cell lines (P<0.001) This clearly demonstrated significant difference in the functioning of the corresponding gene regulatory networks during the progression of prostate cancer from the early to late stages.

Quantitative Proteomics Analysis of Prostate Cancer Cells.

We quantitatively profiled the protein expression changes between LNCaP and CL1 cells using the ICAT-MS/MS protocol described by Han et al. *Nat Biotechnol*, 19: 946-951, 2001. To increase proteome coverage, cells were separated into nuclear, cytosolic and microsomal fractions prior to ICAT analysis as described in Han et al., 2001, supra. We generated a total of 142,849 tandem mass spectra, 7282 of which corresponded to peptides with a mass spectrum quality score P value (Keller, A., et al., *Anal Chem*. 2002 Oct. 15; 74(20):5383-92) greater than 0.9 (allowing unambiguous identification of peptides). These 7282 peptides represented 971 proteins (Keller, A., et al., 2002, supra). We obtained quantitative peptide ratios for 4583 peptides corresponding to 941 proteins. The number of peptides is greater than the number of proteins because 1) mass spectrometry identified multiple peptides from the same protein and 2) the ionization step of mass spectrometry created different charge states for the same peptide. The protein ratios were calculated from multiple peptide ratios using an algorithm for the automated statistical analysis of protein abundance ratios (ASAPRatio) (Li, X. J., et al., *Anal Chem*, 75: 6648-6657, 2003). In the end, we identified 82 proteins that are down regulated and 108 proteins that are up regulated by at least 1.8-fold in LNCaP cells compared with CL1 cells. For example, five proteins belong to annexins that were markers for prostate and other cancers (Hayes, M. J. and Moss, S. E. *Biochem Biophys Res Commun*, 322: 1166-1170, 2004), seven are involved in fatty acids and lipid metabolism that are involved in the carcinogenesis and progression of prostate cancer (Pandian, S. S., et al., *J R Coll Surg Edinb*, 44: 352-361, 1999), five are related to apoptosis, 11 are cancer related, and five proteins are putative transcription factors. As we only identified a limited number of proteins that are significantly differentially expressed due to low sensitivity of ICAT technology, we were only able to identify a few pathways that are perturbed based on ICAT data alone (using the stringent criteria discussed above). This also illustrated the importance of MPSS analysis described earlier.

103 of 190 (54%) differentially expressed proteins identified have enzymatic activity and hence many are involved in metabolism. Notably, many of the proteins identified are involved in fatty acid and lipid metabolism, including fatty acid synthase, carnitine palmitoyltransferase II and propionyl Coenzyme A carboxylase alpha polypeptide. Fatty acid and lipid metabolism is known to be perturbed in prostate cancer (Fleshner, N., et al., *J Urol*, 171: S19-24, 2004). Additionally, many genes involved in lipid transport were altered, including the annexins, prosaposin, and fatty acid binding protein 5. Annexin A1 has previously been shown to be overexpressed in non-PSA-producing LNCaP cells as compared with PSA-producing LNCaP cells (Vaarala, M. H., et al., 2000, supra). Annexin A7 is postulated to be a prostate tumor suppressor gene (Cardo-Vila, M., et al., *Pharmacogenomics J*, 1: 92-94, 2001). Annexin A2 expression is reduced or lost in prostate cancer cells, and its re-expression inhibits prostate cancer cell migration (Liu, J. W., et al., *Oncogene*, 22: 1475-1485, 2003).

Other genes identified here have been implicated in carcinogenesis, including tumor suppressor p16 and insulin-like growth factor 2 receptor (Chi, S. G., et al., *Clin Cancer Res*, 3: 1889-1897, 1997; Kiess, W., et al., *Horm Res*, 41 Suppl 2: 66-73, 1994). Some genes have previously been implicated in prostate cancer, such as prostate cancer over expressed gene 1 POV1, which is over expressed in prostate cancer (Cole, K. A., et al., *Genomics*, 51: 282-287, 1998), and delta 1 and alpha 1 catenin (cadherin-associated protein) and junction plakoglobin, which are down regulated in prostate cancer cells (Kallakury, B. V., et al., *Cancer*, 92: 2786-2795, 2001). However, the potential relationships of most of the proteins identified here to prostate cancer require further elucidation. For example, transmembrane protein 4 (TMEM4), a gene predicted to encode a 182-amino acid type II transmembrane protein, is downregulated about twofold in CL1 cells compared with LNCaP cells. MPSS data also indicated that TMEM4 is down regulated about twofold in CL1 cells. Many type II transmembrane proteins, such as TMPRSS2, are overexpressed in prostate cancer patients (Vaarala, M. H., et al., *Int. J Cancer*, 94: 705-710, 2001). It will be interesting to see whether TMEM4 overexpression plays a primary role in prostate carcinogenesis. We also identified 12 proteins that have not been annotated or functionally characterized.

The mRNA expression level of eight proteins change from 0 tpm in LNCaP cells to greater than 50 tpm (we called them 'digital changes' because they go from zero to some expression) in CL1 cells, and that of one protein changed from 0 tpm in CL1 cells to greater than 50 in LNCaP cells. These genes can be used as digital diagnostic signals. Twenty-two of the differentially expressed proteins were predicted to be secreted proteins (See Table 3) and can be further evaluated as serum marker (see also Example 2 below).

Additionally, we sought to compare the expression at the protein level with that at the mRNA level. We converted the protein IDs and MPSS signatures to Unigene IDs to compare the MPSS data with the ICAT-MS/MS data. We limited this comparison to those with common Unigene IDs and with reliable ICAT ratios (standard deviation less than 0.5) and ended up with a subset of 79 proteins. Of these, 66 genes (83.5%) were concordant in their changes in mRNA and protein levels of expression and 13 genes (16.5%) were discordant, i.e. having higher protein expression but lower mRNA expression or vice versa. There are no functional similarities among the discordant genes. As these mRNAs and proteins are expressed at relatively high levels, discordance due to measurement errors is unlikely. Clearly post-transcriptional mechanism(s) of protein expression are functioning, although the elucidation of the specific mechanism(s) awaits further studies.

Thus, these results, and those described in the Examples below, indicate a systems approach to disease will offer powerful tools for diagnostics, therapeutics, and even aid in prevention in the future.

TABLE 3

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCAGCATGGGCCACG | 73 | NM_001928 | 594-595 | D component of complement (adipsin) |
| GATCTACTACTTGGCCT | 74 | NM_006280 | 596-597 | signal sequence receptor, delta (translocon-associated protein delta) |
| GATCCTGTTGGGAAAGA | 75 | NM_203329 | 598-599 | CD59 antigen p18-20 (antigen identified by monoclonal antibodies 16.3A5, EJ16, EJ30, EL32 and G344) |
| GATCCTGTTGGGAAAGA | 76 | NM_203331 | 600-601 | CD59 antigen p18-20 (antigen identified by monoclonal antibodies 16.3A5, EJ16, EJ30, EL32 and G344) |
| GATCCCTGAAGTTGCCC | 77 | NM_203331 | 600-601 | CD59 antigen p18-20 (antigen identified by monoclonal antibodies 16.3A5, EJ16, EJ30, EL32 and G344) |
| GATCTTGGCTGTATTTA | 78 | NM_203331 | 600-601 | CD59 antigen p18-20 (antigen identified by monoclonal antibodies 16.3A5, EJ16, EJ30, EL32 and G344) |
| GATCCCTGAAGTTGCCC | 79 | NM_203330 | 602-603 | CD59 antigen p18-20 (antigen identified by monoclonal antibodies 16.3A5, EJ16, EJ30, EL32 and G344) |
| GATCCTGTTGGGAAAGA | 80 | NM_203330 | 602-603 | CD59 antigen p18-20 (antigen identified by monoclonal antibodies 16.3A5, EJ16, EJ30, EL32 and G344) |
| GATCTTGGCTGTATTTA | 81 | NM_203330 | 602-603 | CD59 antigen p18-20 (antigen identified by monoclonal antibodies 16.3A5, EJ16, EJ30, EL32 and G344) |
| GATCCCTGAAGTTGCCC | 82 | NM_203329 | 598-599 | CD59 antigen p18-20 (antigen identified by monoclonal antibodies 16.3A5, EJ16, EJ30, EL32 and G344) |
| GATCTTGGCTGTATTTA | 83 | NM_000611 | 604-605 | CD59 antigen p18-20 (antigen identified by monoclonal antibodies 16.3A5, EJ16, EJ30, EL32 and G344) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCCCTGAAGTTGCCC | 84 | NM_000611 | 604-605 | CD59 antigen p18-20 (antigen identified by monoclonal antibodies 16.3A5, EJ16, EJ30, EL32 and G344) |
| GATCCTGTTGGGAAAGA | 85 | NM_000611 | 604-605 | CD59 antigen p18-20 (antigen identified by monoclonal antibodies 16.3A5, EJ16, EJ30, EL32 and G344) |
| GATCTTGGCTGTATTTA | 86 | NM_203329 | 598-599 | CD59 antigen p18-20 (antigen identified by monoclonal antibodies 16.3A5, EJ16, EJ30, EL32 and G344) |
| GATCTGTGCTGACCCCA | 87 | NM_002982 | 606-607 | chemokine (C-C motif) ligand 2 |
| GATCTCTTGGAATGACA | 88 | NM_012242 | 608-609 | dickkopf homolog 1 (*Xenopus laevis*) |
| GATCACCATCAAGCCAG | 89 | NM_012242 | 608-609 | dickkopf homolog 1 (*Xenopus laevis*) |
| GATCAAACAGCTCTAGT | 90 | NM_016308 | 610-611 | UMP-CMP kinase |
| GATCCCCTGTTACGACA | 91 | NM_014155 | 612-613 | HSPC063 protein |
| GATCTCTGATTACCAGC | 92 | NM_025205 | 614-615 | mediator of RNA polymerase II transcription, subunit 28 homolog (yeast) |
| GATCATTGAACGAGACA | 93 | NM_031903 | 616-617 | mitochondrial ribosomal protein L32 |
| GATCACAGACCACGAGT | 94 | NM_178507 | 618-619 | NS5ATP13TP2 protein |
| GATCTGCATCAGTTGTA | 95 | NM_148170 | 620-621 | cathepsin C |
| GATCTCTTGCTAGATTT | 96 | NM_005059 | 622-623 | relaxin 2 |
| GATCACAAGGCTGCCTG | 97 | NM_000405 | 624-625 | GM2 ganglioside activator |
| GATCGTTTCTCATCTCT | 98 | NM_006432 | 626-627 | Niemann-Pick disease, type C2 |
| GATCCCCGCGATACTTC | 99 | NM_015921 | 628-629 | chromosome 6 open reading frame 82 |
| GATCTTTTTTTGGATAT | 100 | NM_181777 | 630-631 | ubiquitin-conjugating enzyme E2A (RAD6 homolog) |
| GATCCGAGAGTAAGGAA | 101 | NM_032488 | 632-633 | cornifelin |
| GATCATGTGTTTCCATG | 102 | NM_014435 | 634-635 | N-acylsphingosine amidohydrolase (acid ceramidase)-like |
| GATCTCAGAACAACCTT | 103 | NM_016029 | 636-637 | dehydrogenase/ reductase (SDR family) member 7 |
| GATCTTACCTCCTGATA | 104 | NM_020467 | 638-639 | hypothetical protein from clone 643 |
| GATCCCAGACTGGTTCT | 105 | NM_003782 | 640-641 | UDP-Gal:betaGlcNAc beta 1,3-galactosyltransferase, polypeptide 4 |
| GATCAAGTGCATTTGAC | 106 | NM_173631 | 642-643 | zinc finger protein 547 |
| GATCAGTGCGTCATGGA | 107 | NM_005423 | 644-645 | trefoil factor 2 (spasmolytic protein 1) |
| GATCCAAGAGGAAGAAT | 108 | NM_014402 | 646-647 | low molecular mass ubiquinone-binding protein (9.5kD) |
| GATCCAGCAAACAGGTT | 109 | NM_003851 | 648-649 | cellular repressor of E1A-stimulated genes 1 |
| GATCATAGAAGGCTATT | 110 | NM_181834 | 650-651 | neurofibromin 2 (bilateral acoustic neuroma) |
| GATCCCCCTTCATTTGA | 111 | NM_004862 | 652-653 | lipopolysaccharide-induced TNF factor |
| GATCCCAAATTTGAAGT | 112 | NM_001685 | 654-655 | ATP synthase, H+ transporting, mitochondrial F0 complex, subunit F6 |
| GATCTGCTTTCTGTAAT | 113 | NM_002406 | 656-657 | mannosyl (alpha-1,3-)-glycoptein beta-1,2-N-acetylglucosaminyltransferase |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCACTCCTTATTTGC | 114 | NM_019021 | 658-659 | hypothetical protein FLJ20010 |
| GATCACCTTCGACGACT | 115 | NM_003130 | 660-661 | sorcin |
| GATCTCTATTGTAATCT | 116 | NM_002489 | 662-663 | NADH dehydrogenase (ubiquinone) 1 alpha subcomplex, 4, 9 kDa |
| GATCTCCTGGCTGCAAA | 117 | NM_138429 | 664-665 | claudin 15 |
| GATCCCAGTCTCTGCCA | 118 | NM_201397 | 666-667 | glutathione peroxidase 1 |
| GATCTTCTTTATAATTC | 119 | NM_004048 | 668-669 | beta-2-microglobulin |
| GATCTGTTCAAACAGCA | 120 | NM_024060 | 670-671 | hypothetical protein MGC5395 |
| GATCGTGCTCACAGGCA | 121 | NM_033280 | 672-673 | SEC11-like 3 (S. cerevisiae) |
| GATCAATATGTAAATAT | 122 | NM_020199 | 674-675 | chromosome 5 open reading frame 15 |
| GATCAGCTTTGCTCCTG | 123 | NM_207495 | 676-677 | hypothetical protein DKFZp686I15217 |
| GATCTCTATGGCTGTAA | 124 | NM_033211 | 678-679 | hypothetical gene supported by AF038182; BC009203 |
| GATCTCAGAACCTCTGT | 125 | NM_00100143 | 680-681 | similar to RIKEN cDNA 4921524J17 |
| GATCCAGCCATTACTAA | 126 | NM_016205 | 682-683 | platelet derived growth factor C |
| GATCTTTCCCAAGATTG | 127 | NM_001001434 | 684-685 | syntaxin 16 |
| GATCGATTCTGTGACAC | 128 | NM_181726 | 686-687 | low density lipoprotein receptor-related protein binding protein |
| GATCTATTTTTTCTAAA | 129 | NM_004125 | 688-689 | guanine nucleotide binding protein (G protein), gamma 10 |
| GATCAAGAATCCTGCTC | 130 | NM_006332 | 690-691 | interferon, gamma-inducible protein 30 |
| GATCGGTGGAGAACCTC | 131 | NM_175742 | 692-693 | melanoma antigen, family A, 2 |
| GATCGGTGGAGAACCTC | 132 | NM_175743 | 694-695 | melanoma antigen, family A, 2 |
| GATCGGTGGAGAACCTC | 133 | NM_153488 | 696-697 | melanoma antigen, family A, 2B |
| GATCATGGGTGAGGGGT | 134 | NM_001483 | 698-699 | glioblastoma amplified sequence |
| GATCCCCCTCACCATGA | 135 | NM_032621 | 700-701 | brain expressed X-linked 2 |
| GATCAACTAATAGCTCT | 136 | NM_181892 | 702-703 | ubiquitin-conjugating enzyme E2D 3 (UBC4/5 homolog, yeast) |
| GATCAAATAAAGTTATA | 137 | NM_181892 | 702-703 | ubiquitin-conjugating enzyme E2D 3 (UBC4/5 homolog, yeast) |
| GATCAAGGAGACCCGGA | 138 | NM_024540 | 704-705 | mitochondrial ribosomal protein L24 |
| GATCAAGGAGACCCGGA | 139 | NM_145729 | 706-707 | mitochondrial ribosomal protein L24 |
| GATCCTAAGCCATAGAC | 140 | NM_025075 | 708-709 | Ngg1 interacting factor 3 like 1 binding protein 1 |
| GATCCATTGAGCCCAGC | 141 | NM_181725 | 710-711 | hypothetical protein FLJ12760 |
| GATCTGAGGGCGTCTTC | 142 | NM_012153 | 712-713 | ets homologous factor |
| GATCTCGGTAGTTACGT | 143 | NM_012153 | 712-713 | ets homologous factor |
| GATCCCAAGATGATTAA | 144 | NM_014177 | 714-715 | chromosome 18 open reading frame 55 |
| GATCTCAAACTTGTCTT | 145 | NM_003350 | 716-717 | ubiquitin-conjugating enzyme E2 variant 2 |
| GATCATAGTTATTATAC | 146 | NM_032466 | 718-719 | aspartate beta-hydroxylase |
| GATCCCAACTGCTCCTG | 147 | NM_005947 | 720-721 | metallothionein 1B (functional) |
| GATCAAAATGCTAAAAC | 148 | NM_016311 | 722-723 | ATPase inhibitory factor 1 |
| GATCTGITTGTTCCCTG | 149 | NM_013411 | 724-725 | adenylate kinase 2 |
| GATCAACAGTGGCAATG | 150 | NM_001001392 | 726-727 | CD44 antigen (homing function and Indian blood group system) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCAATAATAATGAGG | 151 | NM_001001392 | 726-727 | CD44 antigen (homing function and Indian blood group system) |
| GATCAACTAATAGCTCT | 152 | NM_181890 | 728-729 | ubiquitin-conjugating enzyme E2D 3 (UBC4/5 homolog, yeast) |
| GATCAAATAAAGTTATA | 153 | NM_181891 | 730-731 | ubiquitin-conjugating enzyme E2D 3 (UBC4/5 homolog, yeast) |
| GATCAAATAAAGTTATA | 154 | NM_181890 | 728-729 | ubiquitin-conjugating enzyme E2D 3 (UBC4/5 homolog, yeast) |
| GATCAAATAAAGTTATA | 155 | NM_181889 | 732-733 | ubiquitin-conjugating enzyme E2D 3 (UBC4/5 homolog, yeast) |
| GATCAACTAATAGCTCT | 156 | NM_003340 | 734-735 | ubiquitin-conjugating enzyme E2D 3 (UBC4/5 homolog, yeast) |
| GATCAACTAATAGCTCT | 157 | NM_181888 | 736-737 | ubiquitin-conjugating enzyme E2D 3 (UBC4/5 homolog, yeast) |
| GATCAAATAAAGTTATA | 158 | NM_181888 | 736-737 | ubiquitin-conjugating enzyme E2D 3 (UBC4/5 homolog, yeast) |
| GATCAACTAATAGCTCT | 159 | NM_181891 | 730-731 | ubiquitin-conjugating enzyme E2D 3 (UBC4/5 homolog, yeast) |
| GATCAACTAATAGCTCT | 160 | NM_181887 | 738-739 | ubiquitin-conjugating enzyme E2D 3 (UBC4/5 homolog, yeast) |
| GATCAAATAAAGTTATA | 161 | NM_181887 | 738-739 | ubiquitin-conjugating enzyme E2D 3 (UBC4/5 homolog, yeast) |
| GATCAACTAATAGCTCT | 162 | NM_181886 | 740-741 | ubiquitin-conjugating enzyme E2D 3 (UBC4/5 homolog, yeast) |
| GATCAAATAAAGTTATA | 163 | NM_181886 | 740-741 | ubiquitin-conjugating enzyme E2D 3 (UBC4/5 homolog, yeast) |
| GATCAAATAAAGTTATA | 164 | NM_003340 | 734-735 | ubiquitin-conjugating enzyme E2D 3 (UBC4/5 homolog, yeast) |
| GATCAACTAATAGCTCT | 165 | NM_181889 | 732-733 | ubiquitin-conjugating enzyme E2D 3 (UBC4/5 homolog, yeast) |
| GATCTGATTTTTTCCCC | 166 | NM_145751 | 742-743 | TN Freceptor-associated factor 4 |
| GATCAGAAATGACTGTG | 167 | NM_018509 | 744-745 | hypothetical protein PRO1855 |
| GATCACTGAGAAAAAAT | 168 | NM_152407 | 746-747 | GrpE-like 2, mitochondrial (E. coli) |
| GATCCAAGAGTTTAGTG | 169 | NM_006807 | 748-749 | chromobox homolog 1 (HP1 beta homolog Drosophila) |
| GATCTTTGCTGGCAAGC | 170 | NM_002954 | 750-751 | ribosomal protein S27a |
| GATCCACACTGAGAGAG | 171 | NM_145864 | 752-753 | kallikrein 3, (prostate specific antigen) |
| GATCTGTATTATTAAAT | 172 | NM_032549 | 754-755 | IMP2 inner mitochondrial membrane protease-like (S. cerevisiae) |
| GATCTGTTTGTTCCCTG | 173 | NM_172199 | 756-757 | adenylate kinase 2 |
| GATCCCCTGCCTGGTGC | 174 | NM_001312 | 758-759 | cysteine-rich protein 2 |
| GATCAACTAATAGCTCT | 175 | NM_181893 | 760-761 | ubiquitin-conjugating enzyme E2D 3 (UBC4/5 homolog, yeast) |
| GATCAAATAAAGTTATA | 176 | NM_181893 | 760-761 | ubiquitin-conjugating enzyme E2D 3 (UBC4/5 homolog, yeast) |
| GATCTTTTTCAAGTCTT | 177 | NM_012071 | 762-763 | COMM domain containing 3 |
| GATCATGTATGAGATAG | 178 | NM_012460 | 764-765 | translocase of inner mitochondrial membrane 9 homolog (yeast) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCCTTCAGGCAGTAA | 179 | NM_176805 | 766-767 | mitochondrial ribosomal protein S11 |
| GATCITTTTITGGATAT | 180 | NM_003336 | 768-769 | ubiquitin-conjugating enzyme E2A (RAD6 homolog) |
| GATCCCAGTCTCTGCCA | 181 | NM_000581 | 770-771 | glutathione peroxidase 1 |
| GATCAAGACGAGCCTGC | 182 | NM_004864 | 772-773 | growth differentiation factor 15 |
| GATCCCAGCTGATGTAG | 183 | NM_001885 | 774-775 | crystallin, alpha B |
| GATCATGAAGACCTGCT | 184 | NM_003754 | 776-777 | eukaryotic translation initiation factor 3, subunit 5 epsilon, 47 kDa |
| GATCTCAAGGTTGATAG | 185 | NM_003864 | 778-779 | sin3-associated polypeptide, 30 kDa |
| GATCACCAGGCTGCCCA | 186 | NM_148571 | 780-781 | mitochondrial ribosomal protein L27 |
| GATCAAAATGCTAAAAC | 187 | NM_178190 | 782-783 | ATPase inhibitory factor 1 |
| GATCAAGATGACACTGA | 188 | NM_004483 | 784-785 | glycine cleavage system protein H (aminomethyl carrier) |
| GATCGGGAACTCCTGCT | 189 | NM_005952 | 786-787 | metallothionein 1X |
| GATCTTGTCTTTAAAAC | 190 | NM_015646 | 788-789 | RAP1B, member of RAS oncogene family |
| GATCCACACACGTTGGT | 191 | NM_003255 | 790-791 | tissue inhibitor of metalloproteinase 2 |
| GATCATCAGTCACCGAA | 192 | NM_000077 | 792-793 | cyclin-dependent kinase inhibitor 2A (melanoma, p16, inhibits CDK4) |
| GATCCAGTATTCAGTCA | 193 | NM_002166 | 794-795 | inhibitor of DNA binding 2, dominant negative helix-loop-helix protein |
| GATCCTTGCAGGGAGCT | 194 | NM_015343 | 796-797 | dullard homolog (*Xenopus laevis*) |
| GATCTCCTTGCCCCAGC | 195 | NM_015343 | 796-797 | dullard homolog (*Xenopus laevis*) |
| GATCGCCTAGTATGTTC | 196 | NM_003897 | 798-799 | immediate early response 3 |
| GATCAGACTGTATTAAA | 197 | NM_032052 | 800-801 | zinc finger protein 278 |
| GATCGGCCCTACTAGAT | 198 | NM_032052 | 800-801 | zinc finger protein 278 |
| GATCTCCCACTGCGGGG | 199 | NM_032052 | 800-801 | zinc finger protein 278 |
| GATCTGTGATGGTCAGC | 200 | NM_000232 | 802-803 | sarcoglycan, beta (43 kDa dystrophin-associated glycoprotein) |
| GATCACTGTGGTATCTA | 201 | NM_052822 | 804-805 | secretory carrier membrane protein 1 |
| GATCATCAGTCACCGAA | 202 | NM_058197 | 806-807 | cyclin-dependent kinase inhibitor 2A (melanoma, p16, inhibits CDK4) |
| GATCATTTGTTTATTAA | 203 | NM_022334 | 808-809 | integrin beta 1 binding protein 1 |
| GATCAAATATGTAAAAT | 204 | NM_004842 | 810-811 | A kinase (PRKA) anchor protein 7 |
| GATCTCTTGCTAGATTT | 205 | NM_134441 | 812-813 | relaxin 2 |
| GATCACCTTCGACGACT | 206 | NM_198901 | 814-815 | sorcin |
| GATCGGATTGATTAAAA | 207 | NM_020353 | 816-817 | phospholipid scramblase 4 |
| GATCTAGTTGGGAGATA | 208 | NM_153367 | 818-819 | chromosome 10 open reading frame 56 |
| GATCTTTTTTGGCTACT | 209 | NM_018424 | 820-821 | erythrocyte membrane protein band 4.1 like 4B |
| GATCACATTTTCTGTTG | 210 | NM_201436 | 822-823 | H2A histone family, member V |
| GATCACCTGGGTTTCTT | 211 | NM_021999 | 824-825 | integral membrane protein 2B |
| GATCTATTAGATTCAAA | 212 | NM_021105 | 826-827 | phospholipid scramblase 1 |
| GATCTCTTATTTTACAA | 213 | NM_000546 | 828-829 | tumor protein p53 (Li-Fraumeni syndrome) |
| GATCATAGAAGGCTATT | 214 | NM_181835 | 830-831 | neurofibromin 2 (bilateral acoustic neuroma) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCTTCCTGGACAGGA | 215 | NM_152992 | 832-833 | POM (POM121 homolog, rat) and ZP3 fusion |
| GATCAAGGACCGGCCCA | 216 | NM_032391 | 834-835 | small nuclear protein PRAC |
| GATCGCATTTTTGTAAA | 217 | NM_058171 | 836-837 | inhibitor of growth family, member 2 |
| GATCCATCCTCATCTCC | 218 | NM_020188 | 838-839 | DC13 protein |
| GATCGATGGTGGCGCTT | 219 | NM_138992 | | beta-site APP-cleaving enzyme 2 |
| GATCTTATAAAAAGAAA | 220 | NM_017998 | 840-841 | chromosome 9 open reading frame 40 |
| GATCTGAACGATGCCGT | 221 | NM_024579 | 842-843 | hypothetical protein FLJ23221 |
| GATCTCCCCGCCGCAGC | 222 | NM_015973 | 844-845 | galanin |
| GATCGTCGTCCAGGCCA | 223 | NM_032920 | 846-847 | chromosome 21 open reading frame 124 |
| GATCGTTGGGGAACCCC | 224 | NM_199483 | 848-849 | chromosome 20 open reading frame 24 |
| GATCCTATATGTCCTGT | 225 | NM_152344 | 850-851 | hypothetical protein FLJ30656 |
| GATCGATGGTTGACAAT | 226 | NM_004552 | 852-853 | NADH dehydrogenase (ubiquinone) Fe—S protein 5, 15 kDa (NADH-coenzyme Q reductase) |
| GATCTTGTACTAACTTA | 227 | NM_019059 | 854-855 | translocase of outer mitochondrial membrane 7 homolog (yeast) |
| GATCCCGATGTTCTTAA | 228 | NM_001806 | 856-857 | CCAAT/enhancer binding protein (C/EBP), gamma |
| GATCCTGTTTAACAAAG | 229 | NM_015469 | 858-859 | nipsnap homolog 3A (C. elegans) |
| GATCACGCACACACAAT | 230 | NM_198337 | 860-861 | insulin induced gene 1 |
| GATCCAGCCAGACTTGC | 231 | NM_144772 | 862-863 | apolipoprotein A—I binding protein |
| GATCCACACTGGAGAGA | 232 | NM_003450 | 864-865 | zinc finger protein 174 |
| GATCTCAGTTCTGCGTT | 233 | NM_004642 | 866-867 | CDK2-associated protein 1 |
| GATCTACACCTCTTGCC | 234 | NM_052845 | 868-869 | methylmalonic aciduria (cobalamin deficiency) type B |
| GATCCAGCTGGAAAGCT | 235 | NM_006406 | 870-871 | peroxiredoxin 4 |
| GATCCTTCAGGCAGTAA | 236 | NM_022839 | 872-873 | mitochondrial ribosomal protein S11 |
| GATCCACACTGAGAGAG | 237 | NM_001648 | 874-875 | kallikrein 3, (prostate specific antigen) |
| GATCACCTTATGGATGT | 238 | NM_003932 | 876-877 | suppression of tumorigenicity 13 (colon carcinoma) (Hsp70 interacting protein) |
| GATCTAGTTATTTTAAT | 239 | NM_172178 | 878-879 | mitochondria ribosomal protein L42 |
| GATCATTGAGAATGCAG | 240 | NM_206966 | 880-881 | similar to AVLV472 |
| GATCATGCCAAGTGGTG | 241 | NM_058248 | 882-883 | deoxyribonuclease II beta |
| GATCACATTTTCTGTTG | 242 | NM_201516 | 884-885 | H2A histone family, member V |
| GATCAGAAAGAAACCTT | 243 | NM_006744 | 886-887 | retinol binding protein 4, plasma |
| GATCCGTGGCAGGGCTG | 244 | NM_031901 | 888-889 | mitochondrial ribosomal protein S21 |
| GATCCGTGGCAGGGCTG | 245 | NM_018997 | 890-891 | mitochondrial ribosomal protein S21 |
| GATCTATCACCCAAACA | 246 | NM_198157 | 892-893 | ubiquitin-conjugating enzyme E2L 3 |
| GATCAAGCGTGCTTTCC | 247 | NM_000995 | 894-895 | ribosomal protein L34 |
| GATCAAGCGTGCTTTCC | 248 | NM_033625 | 896-897 | ribosomal protein L34 |
| GATCCCTCATCCCTGAA | 249 | NM_014098 | 898-899 | peroxiredoxin 3 |
| GATCCACCTTGGCCTCC | 250 | NM_147187 | 900-901 | tumor necrosis factor receptor superfamily, member 10b |
| GATCTTAGGGAGACAAA | 251 | NM_182529 | 902-903 | TRAP domain containing 5 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCAAGATACGGAAGA | 252 | NM_177924 | 904-905 | N-acylsphingosine amidohydrolase (acid ceramidase) 1 |
| GATCTGTTTGTTCCCTG | 253 | NM_001625 | 906-907 | adenylate kinase 2 |
| GATCAGCAAAAGCCAAA | 254 | NM_201263 | 908-909 | tryptophanyl tRNA synthetase 2 (mitochondrial) |
| GATCGGGGGAGGGTAAA | 255 | NM_004544 | 910-911 | NADH dehydrogenase (ubiquinone) 1 alpha subcomplex, 10, 42 kDa |
| GATCGTGGAGGAGGGAC | 256 | NM_016310 | 912-913 | polymerase (RNA) III (DNA directed) polypeptide K, 12.3 kDa |
| GATCACTTTTGAAAGCA | 257 | NM_018465 | 914-915 | chromosome 9 open reading frame 46 |
| GATCTGATTTGCTAGTT | 258 | NM_015147 | 916-917 | KIAA0582 |
| GATCCTAGGGGGTTTTG | 259 | NM_015147 | 916-917 | KIAA0582 |
| GATCTAAGTTGCCTACC | 260 | NM_014176 | 918-919 | HSPC150 protein similar to ubiquitin-conjugating enzyme |
| GATCTTTGTTCTTGACC | 261 | NM_020531 | 920-921 | chromosome 20 open reading frame 3 |
| GATCTCTTAGCCAGAGG | 262 | NM_153333 | 922-923 | transcription elongation factor A (SII)-like 8 |
| GATCTCTCACCTACA | 263 | NM_003287 | 924-925 | tumor protein D52-like 1 |
| GATCAGAGGTGAAGGGA | 264 | NM_007021 | 926-927 | chromosome 10 open reading frame 10 |
| GATCTCATTGATGTACA | 265 | NM_032947 | 928-929 | putative small membrane protein NID67 |
| GATCTGTGCCGGCTTCC | 266 | NM_005656 | 930-931 | transmembrane protease, serine 2 |
| GATCCGTCTGTGCACAT | 267 | NM_005656 | 930-931 | transmembrane protease, serine 2 |
| GATCGGCTCTGGGAGAC | 268 | NM_006315 | 932-933 | ring finger protein 3 |
| GATCGATTAATGAAGTG | 269 | NM_016326 | 934-935 | chemokine-like factor |
| GATCCTGGACTGGGTAC | 270 | NM_006830 | 936-937 | ubiquinol-cytochrome c reductase (6.4 kD) subunit |
| GATCTTGGAGAATGTGA | 271 | NM_001216 | 938-939 | carbonic anhydrase IX |
| GATCTTTTTTTGGATAT | 272 | NM_181762 | 940-941 | ubiquitin-conjugating enzyme E2A (RAD6 hoinolog) |
| GATCTAGTTATTTAAT | 273 | NM_014050 | 942-943 | mitochondrial ribosomal protein L42 |
| GATCTAGTTATTTAAT | 274 | NM_172177 | 944-945 | mitochondrial ribosomal protein L42 |
| GATCAAGGGACGGCTGA | 275 | NM_000978 | 946-947 | ribosomal protein L23 |
| GATCAGAAGGCTCTGGT | 276 | NM_018442 | 948-949 | IQ motif and WD repeats 1 |
| GATCAATGTTGAAGAAT | 277 | NM_018442 | 948-949 | IQ motif and WD repeats 1 |
| GATCCTGCACTCTAACA | 278 | NM_203339 | 950-951 | clusterin (complement lysis inhibitor, SP-40,40, sulfated glycoprotein 2, testosterone-repressed prostate message 2, apolipoprotein J) |
| GATCTGATTATTTACTI | 279 | NM_004708 | 952-953 | programmed cell death 5 |
| GATCCTTGAAGGCAGCT | 280 | NM_197958 | 954-955 | acheron |
| GATCCCTTTTCTTACTA | 281 | NM_153713 | 956-957 | hypothetical protein MGC46719 |
| GATCTGTCCACTTCTGG | 282 | NM_153713 | 956-957 | hypothetical protein MGC46719 |
| GATCAGATACCACCAAG | 283 | NM_001001503 | 958-959 | NADH dehydrogenase (ubiquinone) flavoprotein 3, 10 kDa |
| GATCCTTTGGATTAATC | 284 | NM_016138 | 960-961 | coenzyme Q7 homolog, ubiquinone (yeast) |
| GATCATTATTTCTGTCT | 285 | NM_018184 | 962-963 | ADP-ribosylation factor-like 10C |
| GATCAGCCCTCAAAGAA | 286 | NM_018184 | 962-963 | ADP-ribosylation factor-like 10C |
| GATCAGCAAAAATAAAG | 287 | NM_016096 | 964-965 | HSPC038 protein |
| GATCTCAGCGGCATTAA | 288 | NM_052951 | 966-967 | deoxynucleotidyltransferase, terminal, interacting protein 1 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCCCTGGAGTGCCTT | 289 | NM_003226 | 968-969 | trefoil factor 3 (intestinal) |
| GATCTGTTTCTACCAAT | 290 | NM_183045 | 970-971 | ring finger protein (C3H2C3 type) 6 |
| GATCCTGCTGTGAAAGG | 291 | NM_153750 | 972-973 | chromosome 21 open reading frame 81 |
| GATCTTGAAAGTGCCTG | 292 | NM_022130 | 974-975 | golgi phosphoprotein 3 (coat-protein) |
| GATCAATACAATAACAA | 293 | NM_003479 | 976-977 | protein tyrosine phosphatase type IVA, member 2 |
| GATCTCCTATGAGAACA | 294 | NM_003479 | 976-977 | protein tyrosine phosphatase type IVA, member 2 |
| GATCAATACAATAACAA | 295 | NM_080391 | 978-979 | protein tyrosine phosphatase type IVA, member 2 |
| GATCTCCTATGAGAACA | 296 | NM_080391 | 978-979 | protein tyrosine phosphatase type IVA, member 2 |
| GATCCAACCCTGTACTG | 297 | NM_177969 | 980-981 | protein phosphatase 1B (formerly 2C), magnesium-dependent, beta isoform |
| GATCTCTACCATTTAAT | 298 | NM_001017 | 982-983 | ribosomal protein S13 |
| GATCCAGAAATACTTAA | 299 | NM_005410 | 984-985 | selenoprotein P, plasma, 1 |
| GATCCAATGCTAAACTC | 300 | NM_005410 | 984-985 | selenoprotein P, plasma, 1 |
| GATCAAATGAGAATAAA | 301 | NM_182620 | 986-987 | family with sequence similarity 33, member A |
| GATCCTTGCCACAAGAA | 302 | NM_004034 | 988-989 | annexin A7 |
| GATCAGACTGTATTAAA | 303 | NM_032051 | 990-991 | zinc finger protein 278 |
| GATCTCCCACTGCGGGG | 304 | NM_032051 | 990-991 | zinc finger protein 278 |
| GATCGGCCCTACTAGAT | 305 | NM_032051 | 990-991 | zinc finger protein 278 |
| GATCAAAAAGCAAGCAG | 306 | NM_015972 | 992-993 | polymerase (RNA) I polypeptide D, 16 kDa |
| GATCACTTCAGCTGCCT | 307 | NM_019007 | 994-995 | armadillo repeat containing, X-linked 6 |
| GATCACCGACTGAAAAT | 308 | NM_002165 | 996-997 | inhibitor of DNA binding 1, dominant negative helix-loop-helix protein |
| GATCAATGAAGTGAGAA | 309 | NM_003094 | 998-999 | small nuclear ribonucleoprotein polypeptide E |
| GATCATCTCAGAAGTCT | 310 | NM_018683 | 1000-1001 | zinc finger protein 313 |
| GATCAGGAAGGACTTGT | 311 | NM_018683 | 1000-1001 | zinc finger protein 313 |
| GATCATTCCCATTTCAT | 312 | NM_002583 | 1002-1003 | PRKC, apoptosis, WT1, regulator |
| GATCGCTTTCTACACTG | 313 | NM_006926 | 1004-1005 | surfactant, pulmonary-associated protein A2 |
| GATCAGTTAGCTTTTAT | 314 | NM_014335 | 1006-1007 | CREBBP/EP300 inhibitor 1 |
| GATCAGTAGTTCAACAG | 315 | NM_175061 | 1008-1009 | juxtaposed with another zinc finger gene 1 |
| GATCCGATAAGTTATTG | 316 | NM_004707 | 1010-1011 | APG12 autophagy 12-like (S. cerevisiae) |
| GATCAGTGGGCACAGTT | 317 | NM_006818 | 1012-1013 | ALL1-fused gene from chromosome 1q |
| GATCAGTGCCAGAAGTC | 318 | NM_016303 | 1014-1015 | WW domain binding protein 5 |
| GATCAGAGAAGTAAGTT | 319 | NM_004871 | 1016-1017 | golgi SNAP receptor complex member 1 |
| GATCTCACTTTCCCCTT | 320 | NM_015373 | 1018-1019 | PKD2 interactor, golgi and endoplasmic reticulum associated 1 |
| GATCAGGCAGTTCCTGG | 321 | NM_213720 | 1020-1021 | chromosome 22 open reading frame 16 |
| GATCCTTGCCACAAGAA | 322 | NM_001156 | 1022-1023 | annexin A7 |
| GATCAAGAAAAATAAGG | 323 | NM_000999 | 1024-1025 | ribosomal protein L38 |
| GATCGATTTCTTTCCTC | 324 | NM_021102 | 1026-1027 | serine protease inhibitor, Kunitz type, 2 |
| GATCATAGAAGGCTATT | 325 | NM_181826 | 1028-1029 | neurofibromin 2 (bilateral acoustic neuroma) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCCGGTGCGCCATGT | 326 | NM_002638 | 1030-1031 | protease inhibitor 3, skin-derived (SKALP) |
| GATCGCAGTTTGGAAAC | 327 | NM_005461 | 1032-1033 | v-maf musculoaponeurotic fibrosarcoma oncogene homolog B (avian) |
| GATCAATTTCAAACCCT | 328 | NM_005461 | 1032-1033 | v-maf musculoaponeurotic fibrosarcoma oncogene homolog B (avian) |
| GATCTCCTATGAGAACA | 329 | NM_080392 | 1034-1035 | protein tyrosine phosphatase type IVA, member 2 |
| GATCAATACAATAACAA | 330 | NM_080392 | 1034-1035 | protein tyrosine phosphatase type IVA, member 2 |
| GATCCTACCACCTACTG | 331 | NM_018281 | 1036-1037 | hypothetical protein FLJ10948 |
| GATCATTTGTTTATTAA | 332 | NM_004763 | 1038-1039 | integrin beta 1 binding protein 1 |
| GATCAAAATGCTAAAAC | 333 | NM_178191 | 1040-1041 | ATPase inhibitory factor 1 |
| GATCTGGGGTGGGAGTA | 334 | NM_002773 | 1042-1043 | protease, serine, 8 (prostasin) |
| GATCATGCTTGTGTGAG | 335 | NM_018648 | 1044-1045 | nucleolar protein family A, member 3 (H/ACA small nucleolar RNPs) |
| GATCAAATATGTAAAAT | 336 | NM_138633 | 1046-1047 | A kinase (PRKA) anchor protein 7 |
| GATCAGACTTCTCAGCT | 337 | NM_006856 | 1048-1049 | activating transcription factor 7 |
| GATCATAGAAGGCTATT | 338 | NM_181827 | 1050-1051 | neurofibromin 2 (bilateral acoustic neuroma) |
| GATCCACCTTGGCCTCC | 339 | NM_003842 | 1052-1053 | tumor necrosis factor receptor superfamily, member 10b |
| GATCTCTGGCCCCTCAG | 340 | NM_198527 | 1054-1055 | Similar to RIKEN cDNA 1110033O09 gene |
| GATCCTCATTGAGCCAC | 341 | NM_024866 | 1056-1057 | adrenomedullin 2 |
| GATCCAGTGGGGTCCGG | 342 | NM_002475 | 1058-1059 | myosin light chain 1 slow a |
| GATCATTTTGTATTAAT | 343 | NM_017544 | 1060-1061 | NF-kappa B repressing factor |
| GATCAGAAAAAGAAAGA | 344 | NM_000982 | 1062-1063 | ribosomal protein L21 |
| GATCCTGTTCCTGTCAC | 345 | NM_203413 | 1064-1065 | S-phase 2 protein |
| GATCATGGTTCTCTTTG | 346 | NM_000202 | 1066-1067 | iduronate 2-sulfatase (Hunter syndrome) |
| GATCCTCTGACCGCTGG | 347 | NM_022365 | 1068-1069 | DnaJ (Hsp40) homolog, subfamily C, member 1 |
| GATCTGCTATTGCCAGC | 348 | NM_016399 | 1070-1071 | hypothetical protein HSPC132 |
| GATCCTGGAAATTGCAG | 349 | NM_001233 | 1072-1073 | caveolin 2 |
| GATCAGTCTCAAGTGTC | 350 | NM_003702 | 1074-1075 | regulator of G-protein signalling 20 |
| GATCAGGTTAGCAAATG | 351 | NM_004331 | 1076-1077 | BCL2/adenovirus E1B 19 kDa interacting protein 3-like |
| GATCAGTATGCTGTTTT | 352 | NM_004968 | 1078-1079 | islet cell autoantigen 1, 69 kDa |
| GATCTGGTTTCTAGCAA | 353 | NM_024096 | 1080-1081 | XTP3-transactivated protein A |
| GATCTAATTAAATAAAT | 354 | NM_000903 | 1082-1083 | NAD(P)H dehydrogenase, quinone 1 |
| GATCCTGGGTTTTTGTG | 355 | NM_017830 | 1084-1085 | OCIA domain containing 1 |
| GATCACCGACTGAAAAT | 356 | NM_181353 | 1086-1087 | inhibitor of DNA binding 1, dominant negative helix-loop-helix protein |
| GATCAGGTAACCAGAGC | 357 | NM_002488 | 1088-1089 | NADH dehydrogenase (ubiquinone) 1 alpha subcomplex, 2, 8 kDa |
| GATCAGTGAACACTAAC | 358 | NM_016645 | 1090-1091 | mesenchymal stem cell protein DSC92 |
| GATCTCAGATGCTAGAA | 359 | NM_016567 | 1092-1093 | BRCA2 and CDKN1A interacting protein |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
| --- | --- | --- | --- | --- |
| GATCGCTCTGCCCATGT | 360 | NM_016567 | 1092-1093 | BRCA2 and CDKN1A interacting protein |
| GATCAGCTCCGTGGGGC | 361 | NM_152398 | 1094-1095 | OCIA domain containing 2 |
| GATCATTGCCCAAAGTT | 362 | NM_152398 | 1094-1095 | OCIA domain containing 2 |
| GATCTGGCACTGTGGTT | 363 | NM_000998 | 1096-1097 | ribosomal protein L37a |
| GATCTGGCACTGTGGGT | 364 | NM_000998 | 1096-1097 | ribosomal protein L37a |
| GATCTCAGATGCTAGAA | 365 | NM_078468 | 1098-1099 | BRCA2 and CDKN1A interacting protein |
| GATCGCTCTGCCCATGT | 366 | NM_078468 | 1098-1099 | BRCA2 and CDKN1A interacting protein |
| GATCTGCTGTGGAATTG | 367 | NM_172316 | 1100-1101 | Meis1, myeloid ecotropic viral integration site 1 homolog 2 (mouse) |
| GATCGTTCTTGATTTTG | 368 | NM_032476 | 1102-1103 | mitochondrial ribosomal protein S6 |
| GATCTTGGTTTCATGTG | 369 | NM_032476 | 1102-1103 | mitochondrial ribosomal protein S6 |
| GATCATTCTTGATTTTG | 370 | NM_032476 | 1102-1103 | mitochondrial ribosomal protein S6 |
| GATCCATATGGAAAGAA | 371 | NM_014171 | 1104-1105 | postsynaptic protein CRIPT |
| GATCTGCCCCCACTGTC | 372 | NM_138929 | 1106-1107 | diablo homolog (*Drosophila*) |
| GATCGCCTAGTATGTTC | 373 | NM_052815 | 1108-1109 | immediate early response 3 |
| GATCAATGCTAATATGA | 374 | NM_005805 | 1110-1111 | proteasome (prosome, macropain) 26S subunit, non-ATPase, 14 |
| GATCAGCATCAGGCTGT | 375 | NM_012459 | 1112-1113 | translocase of inner mitochondrial membrane 8 homolog B (yeast) |
| GATCTGGAAGTGAAACA | 376 | NM_134265 | 1114-1115 | WD repeat and SOCS box-containing 1 |
| GATCCACGTGTGAGGGA | 377 | NM_182640 | 1116-1117 | mitochondrial ribosomal protein S9 |
| GATCACAGAAAAATTAA | 378 | NM_182640 | 1116-1117 | mitochondrial ribosomal protein S9 |
| GATCTCTCTGCGTTTGA | 379 | NM_012445 | 1118-1119 | spondin 2, extracellular matrix protein |
| GATCTCAGAAGTTTTGA | 380 | NM_138459 | 1120-1121 | chromosome 6 open reading frame 68 |
| GATCCGGACTTTTTAAA | 381 | NM_006339 | 1122-1123 | high-mobility group 20B |
| GATCATAGTTATTATAC | 382 | NM_032467 | 1124-1125 | aspartate beta-hydroxylase |
| GATCCTGCCCTGCTCTC | 383 | NM_003145 | 1126-1127 | signal sequence receptor, beta (translocon-associated protein beta) |
| GATCGATTGAGAAGTTA | 384 | NM_012110 | 1128-1129 | cysteine-rich hydrophobic domain 2 |
| GATCCAAGTACTCTCTC | 385 | NM_175081 | 1130-1131 | purinergic receptor P2X, ligand-gated ion channel, 5 |
| GATCATACACCTGCTCA | 386 | NM_001009 | 1132-1133 | ribosomal protein S5 |
| GATCCTGGATGCCACGA | 387 | NM_174889 | 1134-1135 | hypothetical protein LOC91942 |
| GATCCCTGCCACAAGTT | 388 | NM_006923 | 1136-1137 | stromal cell-derived factor 2 |
| GATCAGACGAGGCCATG | 389 | NM_006107 | 1138-1139 | cisplatin resistance-associated overexpressed protein |
| GATCTTTCAGGAAAGAC | 390 | NM_033011 | 1140-1141 | plasminogen activator, tissue |
| GATCTTTTAAAAATATA | 391 | NM_001914 | 1142-1143 | cytochrome b-5 |
| GATCGTTTTGTTTTGTT | 392 | NM_021149 | 1144-1145 | coactosin-like 1 (*Dictyostelium*) |
| GATCTATGGCCTCTGGT | 393 | NM_021643 | 1146-1147 | tribbles homolog 2 (*Drosophila*) |
| GATCCTAAATCATTTTG | 394 | NM_022783 | 1148-1149 | DEP domain containing 6 |
| GATCTAAGAAGAAACTA | 395 | NM_005765 | 1150-1151 | ATPase, H+ transporting, lysosomal accessory protein 2 |
| GATCTTGGTGTTCAAAA | 396 | NM_001497 | 1152-1153 | UDP-Gal:betaGlcNAc beta 1,4-galactosyltransferase, polypeptide 1 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
| --- | --- | --- | --- | --- |
| GATCCCTCATCCCTGAA | 397 | NM_006793 | 1154-1155 | peroxiredoxin 3 |
| GATCTGCAGTGCTTCAC | 398 | NM_178181 | 1156-1157 | CUB domain-containing protein 1 |
| GATCTATGCCCTTGTTA | 399 | NM_033167 | 1158-1159 | UDP-Gal:betaGlcNAc beta 1,3-galactosyltransferase, polypeptide 3 |
| GATCTATGCCCTTGTTA | 400 | NM_033169 | 1160-1161 | UDP-Gal:betaGlcNAc beta 1,3-galactosyltransferase, polypeptide 3 |
| GATCAGTTTATTATTGA | 401 | NM_033169 | 1160-1161 | UDP-Gal:betaGlcNAc beta 1,3-galactosyltransferase, polypeptide 3 |
| GATCTATGCCCTTGTTA | 402 | NM_033168 | 1162-1163 | UDP-Gal:betaGlcNAc beta 1,3-galactosyltransferase, polypeptide 3 |
| GATCAGTTTATTATTGA | 403 | NM_033167 | 1158-1159 | UDP-Gal:betaGlcNAc beta 1,3-galactosyltransferase, polypeptide 3 |
| GATCTATGCCCTTGTTA | 404 | NM_003781 | 1164-1165 | UDP-Gal:betaGlcNAc beta 1,3-galactosyltransferase, polypeptide 3 |
| GATCAGTTTATTATTGA | 405 | NM_003781 | 1164-1165 | UDP-Gal:betaGlcNAc beta 1,3-galactosyltransferase, polypeptide 3 |
| GATCAGTTTATTATTGA | 406 | NM_033168 | 1162-1163 | UDP-Gal:betaGlcNAc beta 1,3-galactosyltransferase, polypeptide 3 |
| GATCGAGTCAAGATGAG | 407 | NM_013442 | 1166-1167 | stomatin (EPB72)-like 2 |
| GATCACCATGATGCAGA | 408 | NM_031905 | 1168-1169 | SVH protein |
| GATCCCGTGTGTGTGTG | 409 | NM_031905 | 1168-1169 | SVH protein |
| GATCATGGTTCTGTTTG | 410 | NM_006123 | 1170-1171 | iduronate 2-sulfatase (Hunter syndrome) |
| GATCCGCAGGCAGAAGC | 411 | NM_002775 | 1172-1173 | Protease, serine, 11 (IGF binding) |
| GATCGATGGTGGCGCTT | 412 | NM_138991 | 1174-1175 | beta-site APP-cleaving enzyme 2 |
| GATCTGCATCAGTTGTA | 413 | NM_001814 | 1176-1177 | cathepsin C |
| GATCTCTACTACCACAA | 414 | NM_001908 | 1178-1179 | cathepsin B |
| GATCTCTACTACCACAA | 415 | NM_147780 | 1180-1181 | cathepsin B |
| GATCTCTACTACCACAA | 416 | NM_147781 | 1182-1183 | cathepsin B |
| GATCTCTACTACCACAA | 417 | NM_147782 | 1184-1185 | cathepsin B |
| GATCTCTACTACCACAA | 418 | NM_147783 | 1186-1187 | cathepsin B |
| GATCGATGGTGGCGCTT | 419 | NM_012105 | 1188-1189 | beta-site APP-cleaving enzyme 2 |
| GATCTTTCAGGAAAGAC | 420 | NM_000931 | 1190-1191 | plasminogen activator, tissue |
| GATCAAATTGCAAAATA | 421 | NM_153705 | 1192-1193 | KDEL (Lys-Asp-Glu-Leu) containing 2 |
| GATCTTATTTTCTGAGA | 422 | NM_014584 | 1194-1195 | ERO1-like (S. cerevisiae) |
| GATCCACAAGGCCTGAG | 423 | NM_001185 | 1196-1197 | alpha-2-glycoprotein 1, zinc |
| GATCTAGGCCTCATCTT | 424 | NM_016352 | 1198-1199 | carboxypeptidase A4 |
| GATCCCTTTGAAATTTT | 425 | NM_001219 | 1200-1201 | calumenin |
| GATCTACAACATATAAA | 426 | NM_020648 | 1202-1203 | twisted gastrulation homolog 1 (Drosophila) |
| GATCAGTTTTTCACCT | 427 | NM_001901 | 1204-1205 | connective tissue growth factor |
| GATCACAGTGTCAGAGA | 428 | NM_007224 | 1206-1207 | neurexophilin 4 |
| GATCGTTACTATGTGTC | 429 | NM_004541 | 1208-1209 | NADH dehydrogenase (ubiquinone) 1 alpha subcomplex, 1, 7.5 kDa |
| GATCATTGACCTCTGTG | 430 | NM_006459 | 1210-1211 | SPFH domain family, member 1 |
| GATCTGAAGCCCAGGTT | 431 | NM_024514 | 1212-1213 | cytochrome P450, family 2, subfamily R, polypeptide 1 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCTGTTAAAAAAAAA | 432 | NM_147159 | 1214-1215 | opioid receptor, sigma 1 |
| GATCTTTCAGGAAAGAC | 433 | NM_000930 | 1216-1217 | plasminogen activator, tissue |
| GATCATAAGACAATGGA | 434 | NM_001657 | 1218-1219 | amphiregulin (schwannoma-derived growth factor) |
| GATCAGTCTTTATTAAT | 435 | NM_013995 | 1220-1221 | lysosomal-associated membrane protein 2 |
| GATCCAGGCTCACTGTG | 436 | NM_005250 | 1222-1223 | forkhead box L1 |
| GATCAAATAATGCGACG | 437 | NM_018064 | 1224-1225 | chromosome 6 open reading frame 166 |
| GATCTTGGTTTTCCATG | 438 | NM_003000 | 1226-1227 | succinate dehydrogenase complex, subunit B, iron sulfur (Ip) |
| GATCTGTTAGTCAAGTG | 439 | NM_005313 | 1228-1229 | glucose regulated protein, 58 kDa |
| GATCATTTCTGGTAAAT | 440 | NM_005313 | 1228-1229 | glucose regulated protein, 58 kDa |
| GATCAAAGCACTCTTCC | 441 | NM_005313 | 1228-1229 | glucose regulated protein, 58 kDa |
| GATCATGCCAAGTGGTG | 442 | NM_021233 | 1230-1231 | deoxyribonuclease II beta |
| GATCATCGCCTCCCTGG | 443 | NM_006216 | 1232-1233 | serine (or cysteine) proteinase inhibitor, clade E (nexin, plasminogen activator inhibitor type 1), member 2 |
| GATCACCAGGCTGCCCA | 444 | NM_016504 | 1234-1235 | mitochondrial ribosomal protein L27 |
| GATCGGATGGGCAAGTC | 445 | NM_002178 | 1236-1237 | insulin-like growth factor binding protein 6 |
| GATCTCAAGACCAAAGA | 446 | NM_030810 | 1238-1239 | thioredoxin domain containing 5 |
| GATCTCACATTGTGCCC | 447 | NM_014254 | 1240-1241 | transmembrane protein 5 |
| GATCAGTCTTTATTAAT | 448 | NM_002294 | 1242-1243 | lysosomal-associated membrane protein 2 |
| GATCAGAGAAGATGATA | 449 | NM_000640 | 1244-1245 | interleukin 13 receptor, alpha 2 |
| GATCAGGTAACCAGAGC | 450 | NM_000591 | 1246-1247 | CD14 antigen |
| GATCATCAGTAAATTTG | 451 | NM_031284 | 1248-1249 | ADP-dependent glucokinase |
| GATCAATAAAATGTGAT | 452 | NM_002658 | 1250-1251 | plasminogen activator, urokinase |
| GATCCCTCGGGTTTTGT | 453 | NM_006350 | 1252-1253 | follistatin |
| GATCTTGCAACTCCATT | 454 | NM_006350 | 1252-1253 | follistatin |
| GATCCAGCATGGAGGCC | 455 | NM_018664 | 1254-1255 | Jun dimerization protein p21SNFT |
| GATCATTGTGAAGGCAG | 456 | NM_001511 | 1256-1257 | chemokine (C-X-C motif) ligand 1 (melanoma growth stimulating activity, alpha) |
| GATCTGCCAGCAGTGTT | 457 | NM_002004 | 1258-1259 | farnesyl diphosphate synthase (farnesyl pyrophosphate synthetase, dimethylallyltranstransferase, geranyltranstransferase) |
| GATCAGAGGTTACTAGG | 458 | NM_006408 | 1260-1261 | anterior gradient 2 homolog (*Xenopus laevis*) |
| GATCCACAGGGGTGGTG | 459 | NM_000602 | 1262-1263 | serine (or cysteine) proteinase inhibitor, clade E (nexin, plasminogen activator inhibitor type 1), member 1 |
| GATCACAAGGGGGGGAT | 460 | NM_016588 | 1264-1265 | neuritin 1 |
| GATCTCTGTTTTGACTA | 461 | NM_004109 | 1266-1267 | ferredoxin 1 |
| GATCTAACCTGGCTTGT | 462 | NM_004109 | 1266-1267 | ferredoxin 1 |
| GATCAGCAAGTGTCCTT | 463 | NM_000935 | 1268-1269 | procollagen-lysine, 2-oxoglutarate 5-dioxygenase 2 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCTAGTGGTTCACAC | 464 | NM_003236 | 1270-1271 | transforming growth factor, alpha |
| GATCAAACAGTTTCTGG | 465 | NM_016139 | 1272-1273 | coiled-coil-helix-coiled-coil-helix domain containing 2 |
| GATCATCAAGAAAAAAG | 466 | NM_018464 | 1274-1275 | chromosome 10 open reading frame 70 |
| GATCCCAGAGAGCAGCT | 467 | NM_002421 | 1276-1277 | matrix metalloproteinase 1 (interstitial collagenase) |
| GATCTTGTGTATTTTTG | 468 | NM_020440 | 1278-1279 | prostaglandin F2 receptor negative regulator |
| GATCTATGTTCTCTCAG | 469 | NM_013363 | 1280-1281 | procollagen C-endopeptidase enhancer 2 |
| GATCAGCAAGTGTCCTT | 470 | NM_182943 | 1282-1283 | procollagen-lysine, 2-oxoglutarate 5-dioxygenase 2 |
| GATCATGTGCTACTGGT | 471 | NM_003172 | 1284-1285 | surfeit 1 |
| GATCTGTAAATAAAATC | 472 | NM_130781 | 1286-1287 | RAB24, member RAS oncogene family |
| GATCAGGGCTGAGGGTA | 473 | NM_000157 | 1288-1289 | glucosidase, beta; acid (includes glucosylceramidase) |
| GATCCTCCTATGTTGTT | 474 | NM_005551 | 1290-1291 | kallikrein 2, prostatic |
| GATCAGAGATGCACCAC | 475 | NM_002997 | 1292-1293 | syndecan 1 |
| GATCTGTCTGTTGCTTG | 476 | NM_005570 | 1294-1295 | lectin, mannose-binding, 1 |
| GATCACCATGAAAGAAG | 477 | NM_003873 | 1296-1297 | neuropilin 1 |
| GATCTGTTAAAAAAAAA | 478 | NM_005866 | 1298-1299 | opioid receptor, sigma 1 |
| GATCAATTCCCTTGAAT | 479 | NM_138322 | 1300-1301 | proprotein convertase subtilisin/kexin type 6 |
| GATCCCAGACCAACCCT | 480 | NM_024642 | 1302-1303 | UDP-N-acetyl-alpha-D-galactosamine:polypeptide N-acetylgalactosaminyltransferase 12 (GalNAc-T12) |
| GATCATCACAGTTTGAG | 481 | NM_002425 | 1304-1305 | matrix metalloproteinase 10 (stromelysin 2) |
| GATCGGAACAGCTCCTT | 482 | NM_178154 | 1306-1307 | fucosyltransferase 8 (alpha (1,6) fucosyltransferase) |
| GATCGGAACAGCTCCTT | 483 | NM_178155 | 1308-1309 | fucosyltransferase 8 (alpha (1,6) fucosyltransferase) |
| GATCGGAACAGCTCCTT | 484 | NM_178156 | 1310-1311 | fucosyltransferase 8 (alpha (1,6) fucosyltransferase) |
| GATCTGTGGGCCCAGTC | 485 | NM_004077 | 1312-1313 | citrate synthase |
| GATCAACCTTAAAGGAA | 486 | NM_000143 | 1314-1315 | fumarate hydratase |
| GATCTTCTACTTGCCTG | 487 | NM_000302 | 1316-1317 | procollagen-lysine 1, 2-oxoglutarate 5-dioxygenase 1 |
| GATCACCAGCCATGTGC | 488 | NM_004390 | 1318-1319 | cathepsin H |
| GATCACCGGAGGTCAGT | 489 | NM_016026 | 1320-1321 | retinol dehydrogenase 11 (all-trans and 9-cis) |
| GATCTATTTTATGCATG | 490 | NM_020792 | 1322-1323 | KIAA1363 protein |
| GATCTGTTAAAAAAAAA | 491 | NM_147157 | 1324-1325 | opioid receptor, sigma 1 |
| GATCATTTTGGTTCGTG | 492 | NM_016417 | 1326-1327 | chromosome 14 open reading frame 87 |
| GATCACTTGTGTACGAA | 493 | NM_024641 | 1328-1329 | mannosidase, endo-alpha |
| GATCCCTCCACCCCCAT | 494 | NM_001441 | 1330-1331 | fatty acid amide hydrolase |
| GATCCAAAGTCATGTGT | 495 | NM_058172 | 1332-1333 | anthrax toxin receptor 2 |
| GATCCATAAATATTTAT | 496 | NM_058172 | 1332-1333 | anthrax toxin receptor 2 |
| GATCTGCCTGCATCCTG | 497 | NM_003225 | 1334-1335 | trefoil factor 1 (breast cancer, estrogen-inducible sequence expressed in) |
| GATCCAGTGTCCATGGA | 498 | NM_007085 | 1336-1337 | follistatin-like 1 |
| GATCAATTCCCTTGAAT | 499 | NM_138324 | 1338-1339 | proprotein convertase subtilisin/kexin type 6 |
| GATCCGTGTGCTTGGGC | 500 | NM_018143 | 1340-1341 | kelch-like 11 (Drosophila) |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCCAGGGTCCCCCAG | 501 | NM_004911 | 1342-1343 | protein disulfide isomerase related protein (calcium-binding protein, intestinal-related) |
| GATCATGGGACCCTCTC | 502 | NM_003032 | 1344-1345 | sialyltransferase 1 (beta-galactoside alpha-2,6-sialyltransferase) |
| GATCATGGGACCCTCTC | 503 | NM_173216 | 1346-1347 | sialyltransferase 1 (beta-galactoside alpha-2,6-sialyltransferase) |
| GATCTCACTGTTATTAT | 504 | NM_007115 | 1348-1349 | tumor necrosis factor, alpha-induced protein 6 |
| GATCCTGTATCCAAATC | 505 | NM_007115 | 1348-1349 | tumor necrosis factor, alpha-induced protein 6 |
| GATCAGTTTTCTCTTAA | 506 | NM_024769 | 1350-1351 | adipocyte-specific adhesion molecule |
| GATCTACCAGATAACCT | 507 | NM_000522 | 1352-1353 | homeo box A13 |
| GATCCTAGTAATTGCCT | 508 | NM_054034 | 1354-1355 | fibronectin 1 |
| GATCAATGCAACGACGT | 509 | NM_006833 | 1356-1357 | COP9 constitutive photomorphogenic homolog subunit 6 (Arabidopsis) |
| GATCAATTCCCTTGAAT | 510 | NM_138325 | 1358-1359 | proprotein convertase subtilisin/kexin type 6 |
| GATCAATTCCCTTGAAT | 511 | NM_138323 | 1360-1361 | proprotein convertase subtilisin/kexin type 6 |
| GATCCCAGAGGGATGCA | 512 | NM_024040 | 1362-1363 | CUE domain containing 2 |
| GATCATCAAAAATGCTA | 513 | NM_017898 | 1364-1365 | hypothetical protein FLJ20605 |
| GATCCCTCGGGTTTTGT | 514 | NM_013409 | 1366-1367 | follistatin |
| GATCTTGCAACTCCATT | 515 | NM_013409 | 1366-1367 | follistatin |
| GATCTTGTTAATGCATT | 516 | NM_001873 | 1368-1369 | carboxypeptidase E |
| GATCAAAGGTTTAAAGT | 517 | NM_001627 | 1370-1371 | activated leukocyte cell adhesion molecule |
| GATCACCAAGATGCTTC | 518 | NM_018371 | 1372-1373 | chondroitin beta1,4 N-acetylgalactosaminyltransferase |
| GATCAAATGTGCCTTAA | 519 | NM_014918 | 1374-1375 | carbohydrate (chondroitin) synthase 1 |
| GATCTTCGGCCTCATTC | 520 | NM_017860 | 1376-1377 | hypothetical protein FLJ20519 |
| GATCCCTTCTGCCCTGG | 521 | NM_022367 | 1378-1379 | sema domain, immunoglobulin domain (Ig), transmembrane domain (TM) and short cytoplasmic domain, (semaphorin) 4A |
| GATCCAACCGACTGAAT | 522 | NM_006670 | 1380-1381 | trophoblast glycoprotein |
| GATCTCTGCAGATGCCA | 523 | NM_004750 | 1382-1383 | cytokine receptor-like factor 1 |
| GATCACAAAATGTTGCC | 524 | NM_001077 | 1384-13852 | UDP glycosyltransferase family, polypeptide B17 |
| GATCTCTCTTTCTCTCT | 525 | NM_031882 | 1386-1387 | protocadherin alpha subfamily C, 1 |
| GATCTCTCTTTCTCTCT | 526 | NM_031860 | 1388-1389 | protocadherin alpha 10 |
| GATCTCTCTTTCTCTCT | 527 | NM_018906 | 1390-1391 | protocadherin alpha 3 |
| GATCTCTCTTTCTCTCT | 528 | NM_031411 | 1392-1393 | protocadherin alpha 1 |
| GATCACAGGCGTGAGCT | 529 | NM_032620 | 1394-1395 | GTP binding protein 3 (mitochondrial) |
| GATCAACATCTTTTCTT | 530 | NM_004343 | 1396-1397 | calreticulin |
| GATCTCTGATTTAACCG | 531 | NM_002185 | 1398-1399 | interleukin 7 receptor |
| GATCTCTCTTTCTCTCT | 532 | NM_031497 | 1400-1401 | protocadherin alpha 3 |
| GATCCATTTTTAATGGT | 533 | NM_198278 | 1402-1403 | hypothetical protein LOC255743 |
| GATCTTTTCTAAATGTT | 534 | NM_005699 | 1404-1405 | interleukin 18 binding protein |
| GATCTCTCTTTCTCTCT | 535 | NM_031410 | 1406-1407 | protocadherin alpha 1 |
| GATCGGTGCGTTCTCCT | 536 | NM_005561 | 1408-1409 | lysosomal-associated membrane protein 1 |
| GATCTTTTCTAAATGTT | 537 | NM_173042 | 1410-1411 | interleukin 18 binding protein |
| GATCTTTTCTAAATGTT | 538 | NM_173043 | 1412-1413 | interleukin 18 binding protein |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
| --- | --- | --- | --- | --- |
| GATCTCTCTTTCTCTCT | 539 | NM_031496 | 1414-1415 | protocadherin alpha 2 |
| GATCCTGTTGGATGTGA | 540 | NM_080927 | 1416-1417 | discoidin, CUB and LCCL domain containing 2 |
| GATCTCTCTTTCTCTCT | 541 | NM_031864 | 1418-1419 | protocadherin alpha 12 |
| GATCTCTCTTTCTCTCT | 542 | NM_031849 | 1420-1421 | protocadherin alpha 6 |
| GATCCTGTGCTTCTGCA | 543 | NM_006464 | 1422-1423 | trans-golgi network protein 2 |
| GATCTCTCTTTCTCTCT | 544 | NM_031865 | 1424-1425 | protocadherin alpha 13 |
| GATCTGATGAAGTATAT | 545 | NM_022746 | 1426-1427 | hypothetical protein FLJ22390 |
| GATCACTTGTCTTGTGG | 546 | NM_006988 | 1428-1429 | a disintegrin-like and metalloprotease (reprolysin type) with thrombospondin type 1 motif, 1 |
| GATCTTTTCTAAATGTT | 547 | NM_173044 | 1430-1431 | interleukin 18 binding protein |
| GATCTCTCTTTCTCTCT | 548 | NM_031856 | 1432-1433 | protocadherin alpha 8 |
| GATCTCTCTTTCTCTCT | 549 | NM_031500 | 1434-1435 | protocadherin alpha 4 |
| GATCAGCACTGCCAGTG | 550 | NM_016592 | 1436-1437 | GNAS complex locus |
| GATCCGGAAAGATGAAT | 551 | NM_144640 | 1438-1439 | interleukin 17 receptor E |
| GATCTCTCTTTCTCTCT | 552 | NM_031501 | 1440-1441 | protocadherin alpha 5 |
| GATCTCTCTTTCTCTCT | 553 | NM_031495 | 1442-1443 | protocadherin alpha 2 |
| GATCTAATGTAAAATCC | 554 | NM_002354 | 1444-1445 | tumor-associated calcium signal transducer 1 |
| GATCTTCTTTTGTAATG | 555 | NM_032780 | 1446-1447 | transmembrane protein 25 |
| GATCAATAATAATGAGG | 556 | NM_001001390 | 1448-1449 | CD44 antigen (homing function and Indian blood group system) |
| GATCAACAGTGGCAATG | 557 | NM_001001390 | 1448-1449 | CD44 antigen (homing function and Indian blood group system) |
| GATCAACAGTGGCAATG | 558 | NM_001001391 | 1450-1451 | CD44 antigen (homing function and Indian blood group system) |
| GATCAATAATAATGAGG | 559 | NM_001001391 | 1450-1451 | CD44 antigen (homing function and Indian blood group system) |
| GATCATTGCTCCTTCTC | 560 | NM_004872 | 1452-1453 | chromosome 1 open reading frame 8 |
| GATCTCTGCATTTTATA | 561 | NM_020198 | 1454-1455 | GK001 protein |
| GATCTATGAAATCTGTG | 562 | NM_020198 | 1454-1455 | GK001 protein |
| GATCTCTCTTTCTCTCT | 563 | NM_018901 | 1456-1457 | protocadherin alpha 10 |
| GATCACTGGAGCTGTGG | 564 | NM_002116 | 1458-1459 | major histocompatibility complex, class I, A |
| GATCATCCAGTTTGCTT | 565 | NM_004540 | 1460-1461 | neural cell adhesion molecule 2 |
| GATCAAAATTGTTACCC | 566 | NM_004540 | 1460-1461 | neural cell adhesion molecule 2 |
| GATCAACAGTGGCAATG | 567 | NM_001001389 | 1462-1463 | CD44 antigen (homing function and Indian blood group system) |
| GATCAATAATAATGAGG | 568 | NM_001001389 | 1462-1463 | CD44 antigen (homing function and Indian blood group system) |
| GATCAACAGTGGCAATG | 569 | NM_000610 | 1464-1465 | CD44 antigen (homing function and Indian blood group system) |
| GATCAATAATAATGAGG | 570 | NM_000610 | 1464-1465 | CD44 antigen (homing function and Indian blood group system) |
| GATCCATACTGTTTGGA | 571 | NM_001792 | 1466-1467 | cadherin 2, type 1, N-cadherin (neuronal) |
| GATCTGCATTTTCAGAA | 572 | NM_015544 | 1468-1469 | DKFZP564K1964 protein |
| GATCCCATTTTTTGGTA | 573 | NM_000574 | 1470-1471 | decay accelerating factor for complement (CD55, Cromer blood group system) |
| GATCTGCAGTGCTTCAC | 574 | NM_022842 | 1472-1473 | CUB domain-containing protein 1 |

TABLE 3-continued

DIFFERENTIALLY EXPRESSED GENES THAT ENCODE PREDICTED SECRETED PROTEINS.

| Signature | SEQ ID NO: | Accession Number | SEQ ID NOS: | Description |
|---|---|---|---|---|
| GATCTGTTAAAAAAAAA | 575 | NM_147160 | 1474-1475 | opioid receptor, sigma 1 |
| GATCATAGGTCTGGACA | 576 | NM_014045 | 1476-1477 | low density lipoprotein receptor-related protein 10 |
| GATCTAATACTACTGTC | 577 | NM_001110 | 1478-1479 | a disintegrin and metalloproteinase domain 10 |
| GATCTCTTGAGGCTGGG | 578 | NM_016371 | 1480-1481 | hydroxysteroid (17-beta) dehydrogenase 7 |
| GATCGTTCATTGCCTTT | 579 | NM_001746 | 1482-1483 | calnexin |
| GATCTCTCTTTCTCTCT | 580 | NM_018900 | 1484-1485 | protocadherin alpha 1 |
| GATCTGACCTGGTGAGA | 581 | NM_004393 | 1486-1487 | dystroglycan 1 (dystrophin-associated glycoprotein 1) |
| GATCATCTTTCCTGTTC | 582 | NM_002117 | 1488-1489 | major histocompatibility complex, class I, C |
| GATCGTAAAATTTTAAG | 583 | NM_003816 | 1490-1491 | a disintegrin and metalloproteinase domain 9 (meltrin gamma) |
| GATCTCTCTTTCTCTCT | 584 | NM_018904 | 1492-1493 | protocadherin alpha 13 |
| GATCTCTCTTTCTCTCT | 585 | NM_018911 | 1494-1495 | protocadherin alpha 8 |
| GATCTCTCTTTCTCTCT | 586 | NM_018905 | 1496-1497 | protocadherin alpha 2 |
| GATCTCTCTTTCTCTCT | 587 | NM_018903 | 1498-1499 | protocadherin alpha 12 |
| GATCTCTCTTTCTCTCT | 588 | NM_018907 | 1500-1501 | protocadherin alpha 4 |
| GATCTCTCTTTCTCTCT | 589 | NM_018908 | 1502-1503 | protocadherin alpha 5 |
| GATCCGGAAAGATGAAT | 590 | NM_153480 | 1504-1505 | interleukin 17 receptor E |
| GATCCGGAAAGATGAAT | 591 | NM_153483 | 1506-1507 | interleukin 17 receptor E |
| GATCTCTGTAATTTTAT | 592 | NM_021923 | 1508-1509 | fibroblast growth factor receptor-like 1 |
| GATCTAAGAGATTAATA | 593 | NM_004362 | 1510-1511 | calmegin |

Example 2

Identification of Secreted Proteins by Computational Analysis of MPSS Signature Sequences Secreted proteins can readily be exploited for blood cancer diagnosis and prognosis. As such, the differentially expressed genes identified in Example 1 were further analyzed to determine how many of the differentially expressed genes encode secreted proteins. Proteins with signal peptides (classical secretory proteins) were predicted using the same criteria described by Chen et al., Mamm Genome, 14: 859-865, 2003, with the SignalP 3.0 server developed by The Center for Biological Sequence Analysis, Lyngby, Denmark (http colon double slash www dot cbs dot dtu dot dk slash services slash SignalP-3.0; see also, J. D. Bendtsen, et al., *J. Mol. Biol.*, 340:783-795, 2004.) and the TMHMM2.0 server (see for example A. Krogh, et al., *Journal of Molecular Biology*, 305 (3):567-580, January 2001; E. L. L. Sonnhammer, et al., In J. Glasgow, T. Littlejohn, F. Major, R. Lathrop, D. Sankoff, and C. Sensen, editors, *Proceedings of the Sixth International Conference on Intelligent Systems for Molecular Biology*, pages 175-182, Menlo Park, Calif., 1998. AAAI Press). Putatively nonclassical secretory secreted proteins (without signal peptides) were predicted based on the SecretomeP 1.0 server, (httpcolon double slash www dot cbs dot dtu dot dkslash services slash SecretomeP-1.0 slash) and required an odds ratio score >3.

Five hundred and twenty one signatures belonging to 460 genes potentially encoding secreted proteins (Table 3) were identified. Among these, 287 (259 genes) and 234 (201 genes) signatures were overexpressed or underexpressed in CL1 cells compared with LNCaP cells. Thus these proteins can be used in blood diagnostics to follow prostate cancer progression.

Example 3

Prostate Cancer Diagnostics Using Multiparameter Analysis

This example describes a multiparameter diagnostic fingerprint using the WDR19 prostate-specific secreted protein in combination with PSA. The WDR19 prostate-specific protein is diagnostically superior to PSA when used alone and further improved prostate cancer detection when used in combination with PSA.

WDR19 was previously identified as relatively tissue-specific by cDNA array studies and Northern blot analysis (see e.g., U.S. Patent Application Publication No. 20020150893). This protein was selected, expressed as protein, purified and antibodies were made against it, all using standard techniques known in the art (the cDNA encoding the WDR19 protein is provided in SEQ ID NO:1, the amino acid sequence is provided in SEQ ID NO:2). The WDR19-specific antibody was shown to be an excellent tissue-specific marker of prostate cancer with staining of the specific epithelial cells being directly proportional to the progression of the cancer. In this regard it is very different from the well-established PSA marker which is not a good prostate tissue cancer marker.

The WDR19 antibodies and those for the well-established PSA prostate cancer blood marker were used to analyze 10 blood samples from normal individuals, 10 blood samples from early prostate cancer patients and 10 blood samples from late prostate cancer patients. The results showed that WDR19 reacted against no normals, against 5/10 early cancers, and against 5/10 late cancers, whereas PSA reacted against no normals, no early cancers and 7/10 late cancers. The two markers together detected all the late cancers. Thus the mutiparameter analysis of blood markers (e.g. the analyses of multiple markers) for prostate cancer was far more powerful than using each marker alone.

Accordingly, the results show a molecular blood fingerprint that comprises the WDR19 and PSA proteins. This fingerprint allows superior diagnostic power to PSA alone and further improves prostate cancer detection.

WDR19 was also shown to be an effective histochemical marker for prostate cancer. Two hundred and seventy-five tissue cores that contain both stromal and epithelial cells from cancer patients, 17 from benign prostatic hyperplasia (BPH) and 12 from normal individuals were examined. The mean WDR19 protein staining intensities were 2.52 [standard error (S.E.), 0.05; 95% confidence interval (CI), 2.41-2.61] for prostate cancer; 1.03 BPH (S.E. 0.03; 95% CI, 0.96-1.09); and 1.0 (S.E., 0, 95% CI 1.0-1.0) for normal individuals. Pair-wise comparisons (using independent t-test) demonstrated that WDR19 staining intensity is significantly different between prostate cancer and BPH (mean difference 1.49; P<0.0001) and between prostate cancers and normal (mean difference 1.52; P<0.0001). These data suggested that WDR19, in addition to being a prostate-specific blood biomarker, is a quantitative cancer-specific marker for prostate tissues.

Example 4

Identification of Organ-Specific Secreted Proteins Using MPSS and Computational Analysis MPSS as described in Example 1 and in the detailed description, was used to identify more than 2 million transcripts from each of the prostate cell lines (see Example 1) and in normal prostate tissue. The MPSS signature sequences from normal prostate were compared against 29 other tissues each with about 1 million or more mRNA transcripts. This comparison revealed that about 300 of these transcripts are organ-specific and about 60 of these organ-specific transcripts are potentially secreted into the blood. (See Table 4).

TABLE 4

PROSTATE-SPECIFIC
PROTEINS POTENTIALLY SECRETED INTO BLOOD

| Accession No. | SEQ ID NO: | Annotations/Description |
|---|---|---|
| NP_001176 | 1512 | alpha-2-glycoprotein 1, zinc; Alpha-2-glycoprotein, zinc [Homo sapiens] |
| NP_001719 | 1513 | basigin isoform 1; OK blood group; collagenase stimulatory factor; M6 antigen; extracellular matrix metalloproteinase inducer [Homo sapiens] |
| NP_940991 | 1514 | basigin isoform 2; OK blood group; collagenase stimulatory factor; M6 antigen; extracellular matrix metalloproteinase inducer [Homo sapiens] |
| NP_004039 | 1515 | beta-2-microglobulin precursor [Homo sapiens] |
| NP_002434 | 1516 | beta-microseminoprotein isoform a precursor; seminal plasma beta-inhibin; prostate secreted seminal plasma protein; immunoglobulin binding factor; prostatic secretory protein 94 [Homo sapiens] |
| NP_619540 | 1517 | beta-microseminoprotein isoform b precursor; seminal plasma beta-inhibin; prostate secreted seminal plasma protein; immunoglobulin binding factor; prostatic secretory protein 94 [Homo sapiens] |

TABLE 4-continued

PROSTATE-SPECIFIC
PROTEINS POTENTIALLY SECRETED INTO BLOOD

| Accession No. | SEQ ID NO: | Annotations/Description |
|---|---|---|
| NP_817089 | 1518 | cadherin-like 26 isoform a; cadherin-like protein VR20 [Homo sapiens] |
| NP_068582 | 1519 | cadherin-like 26 isoform b; cadherin-like protein VR20 [Homo sapiens] |
| NP_001864 | 1520 | carboxypeptidase E precursor [Homo sapiens] |
| NP_004807 | 1521 | chromosome 9 open reading frame 61; Friedreich ataxia region gene X123 [Homo sapiens] |
| NP_001271 | 1522 | cold inducible RNA binding protein; Cold-inducible RNA-binding protein; cold inducible RNA-binding protein; glycine-rich RNA binding protein [Homo sapiens] |
| NP_008977 | 1523 | elastin microfibril interfacer 1; TNF? elastin microfibril interface located protein; elastin microfibril interface located protein [Homo sapiens] |
| NP_004104 | 1524 | fibroblast growth factor 12 isoform 2; fibroblast growth factor 12B; fibroblast growth factor homologous factor 1; myocyte-activating factor; fibroblast growth factor FGF-12b [Homo sapiens] |
| NP_005962 | 1525 | FXYD domain containing ion transport regulator 3 isoform 1 precursor; phospholemman-like protein; FXYD domain-containing ion transport regulator 3 [Homo sapiens] |
| NP_068710 | 1526 | FXYD domain containing ion transport regulator 3 isoform 2 precursor; phospholemman-like protein; FXYD domain-containing ion transport regulator 3 [Homo sapiens] |
| NP_006352 | 1527 | homeo box B13; homeobox protein HOX-B13 [Homo sapiens] |
| NP_002139 | 1528 | homeo box D10; homeobox protein Hox-D10; homeo box 4D; Hox-4 |
| NP_000513 | 1529 | homeobox protein A13; homeobox protein HOXA13; homeo box 1J; transcription factor HOXA13 [Homo sapiens] |
| NP_060819 | 1530 | hypothetical protein FLJ11175 [Homo sapiens] |
| NP_078985 | 1531 | hypothetical protein FLJ14146 [Homo sapiens] |
| NP_061894 | 1532 | hypothetical protein FLJ20010 [Homo sapiens] |
| NP_115617 | 1533 | hypothetical protein FLJ23544; QM gene; DNA segment on chromosome X (unique) 648 expressed sequence; 60S ribosomal protein L10; tumor suppressor QM; Wilms tumor-related protein; laminin receptor homolog [Homo sapiens] |
| NP_057582 | 1534 | hypothetical protein HSPC242 [Homo sapiens] |
| NP_116285 | 1535 | hypothetical protein MGC14388 [Homo sapiens] |
| NP_116293 | 1536 | hypothetical protein MGC14433 [Homo sapiens] |
| NP_077020 | 1537 | hypothetical protein MGC4309 [Homo sapiens] |
| NP_061074 | 1538 | hypothetical protein PRO1741 [Homo sapiens] |
| NP_563614 | 1539 | hypothetical protein similar to KIAA0187 gene product [Homo sapiens] |
| NP_951038 | 1540 | I-mfa domain-containing protein isoform p40 [Homo sapiens] |
| NP_005542 | 1541 | kallikrein 2, prostatic isoform 1; glandular kallikrein 2 [Homo sapiens] |
| NP_004908 | 1542 | kallikrein 4 preproprotein; protease, serine, 17; enamel matrix serine protease 1; kallikrein-like protein 1; protease; androgen-regulated message 1 [Homo sapiens] |
| NP_002328 | 1543 | low density lipoprotein receptor-related protein associated protein 1; lipoprotein receptor associated protein; alpha-2-MRAP; alpha-2-macroglobulin receptor-associated protein 1; low density lipoprotein-related protein-associated protein 1; low density li |
| NP_859077 | 1544 | low density lipoprotein receptor-related protein binding protein [Homo sapiens] |
| NP_000897 | 1545 | natriuretic peptide receptor A/guanylate cyclase A (atrionatriuretic peptide receptor A); Natriuretic peptide receptor A/guanylate cyclase A [Homo sapiens] |
| NP_085048 | 1546 | Nedd4 family interacting protein 1; Nedd4 WW domain-binding protein 5 [Homo sapiens] |
| NP_000896 | 1547 | neuropeptide Y [Homo sapiens] |

TABLE 4-continued

PROSTATE-SPECIFIC PROTEINS POTENTIALLY SECRETED INTO BLOOD

| Accession No. | SEQ ID NO: | Annotations/Description |
|---|---|---|
| NP_039227 | 1548 | olfactory receptor, family 10, subfamily H, member 2 [Homo sapiens] |
| NP_000599 | 1549 | orosomucoid 2; alpha-1-acid glycoprotein, type 2 [Homo sapiens] |
| NP_002643 | 1550 | prolactin-induced protein; prolactin-inducible protein [Homo sapiens] |
| NP_057674 | 1551 | prostate androgen-regulated transcript 1 protein; prostate-specific and androgen-regulated cDNA 14D7 protein [Homo sapiens] |
| NP_001639 | 1552 | prostate specific antigen isoform 1 preproprotein; gamma-seminoprotein; semenogelase; seminin; P-30 antigen [Homo sapiens] |
| NP_665863 | 1553 | prostate specific antigen isoform 2; gamma-seminoprotein; semenogelase; seminin; P-30 antigen [Homo sapiens] |
| NP_001090 | 1554 | prostatic acid phosphatase precursor [Homo sapiens] |
| NP_001000 | 1555 | ribosomal protein S5; 40S ribosomal protein S5 [Homo sapiens] |
| NP_005658 | 1556 | ring finger protein 103; Zinc finger protein expressed in cerebellum; zinc finger protein 103 homolog (mouse) [Homo sapiens] |
| NP_937761 | 1557 | ring finger protein 138 isoform 2 [Homo sapiens] |
| NP_002998 | 1558 | semenogelin I isoform a preproprotein [Homo sapiens] |
| NP_937782 | 1559 | semenogelin I isoform b preproprotein [Homo sapiens] |
| XP_353669 | 1560 | similar to HIC protein isoform p32 [Homo sapiens] |
| NP_003855 | 1561 | sin3 associated polypeptide p30 [Homo sapiens] |
| NP_036581 | 1562 | six transmembrane epithelial antigen of the prostate; six transmembrane epithelial antigen of the prostate (NOTE: non-standard symbol and name) [Homo sapiens] |
| NP_008868 | 1563 | SMT3 suppressor of mif two 3 homolog 2; SMT3 (suppressor of mif two 3, yeast) homolog 2 [Homo sapiens] |
| NP_066568 | 1564 | solute carrier family 15 (H+/peptide transporter), member 2 [Homo sapiens] |
| NP_055394 | 1565 | solute carrier family 39 (zinc transporter), member 2 [Homo sapiens] |
| NP_003209 | 1566 | telomeric repeat binding factor 1 isoform 2; Telomeric repeat binding factor 1; telomeric repeat binding protein 1 [Homo sapiens] |
| NP_110437 | 1567 | thioredoxin domain containing 5 isoform 1; thioredoxin related protein; endothelial protein disulphide isomerase [Homo sapiens] |
| NP_004863 | 1568 | thymic dendritic cell-derived factor 1; liver membrane-bound protein [Homo sapiens] |
| NP_665694 | 1569 | TNF receptor-associated factor 4 isoform 2; tumor necrosis receptor-associated factor 4A; malignant 62; cysteine-rich domain associated with ring and TRAF domain [Homo sapiens] |
| NP_005647 | 1570 | transmembrane protease, serine 2; epitheliasin [Homo sapiens] |
| NP_008931 | 1571 | uroplakin 1A [Homo sapiens] |
| NP_036609 | 1572 | WW domain binding protein 1 [Homo sapiens] |
| NP_009062 | 1573 | zinc finger protein 75 [Homo sapiens] |

Example 5

Comparison of Localized Prostate Cancer and Prostate Cancer Metastases in the Liver In an additional experiment, the transcriptome from normal prostate tissue was compared to the transcriptome of each of the LNCaP and CL-1 prostate cancer cell lines. The comparison showed that the transcriptomes were distinct for the normal tissue, the early prostate cancer and the late prostate cancer. An additional comparison was carried out between localized prostate cancer and metastases in the liver. About 6,000 genes were identified that were significantly changed between the localized prostate cancer and the metastasized cancer and again, many of the changed genes encoded secreted proteins that can be part of the blood fingerprints indicative of the more advanced disease status of metastases. The metastases-altered blood fingerprints may indicate the site of metastases.

These experiments demonstrate that there are continuous changes in the two types of networks as prostate cancer progresses—from localized to androgen independence to metastases. These graded network transitions suggest that one will be able to detect the very earliest stages of prostate cancer and, accordingly, that the organ-specific, molecular blood fingerprints approach described herein will also permit a very early diagnosis of prostate and other types of cancers.

Example 6

MPSS Analysis in a Yeast Model System

This experiment demonstrates perturbation-specific fingerprints of patterns of gene expression for nuclear, cytoplasmic, membrane-bound and secreted proteins in the yeast metabolic system that converts the sugar galactose into glucose-6-phosphate (the gal system).

The gal systems includes 9 proteins. In the course of studying how this systems works, 9 new strains of yeast were created, each with a different one of the 9 relevant genes destroyed (gene knockouts). Yeast is a single celled eukaryote organism with about 6,000 genes. The expression patterns of each of the 6,000 genes was studied in the wild type yeast and each of the 9 knockout strains. The data from these experiments showed: 1) the wild type and each of knock out strains exhibited statistically significant changes in patterns of gene expression from the wild type strain ranging from 89 to 465 altered patterns of gene expression; 2) each of these patterns of changed gene expression were unique; and 3) on average about 15% of the genes with changed expression patterns encoded proteins that were potentially secreted (as determined by computational analysis from the sequence of the gene). These genes are as follows: (listed by gene name as available through the public yeast genome database at http://www.yeastgenome.org/. The genomic DNA, cDNA and amino acid sequences corresponding to each of the listed genes are publicly available, for example, through the yeast genome database.) YGL102C, YGL069C, YLL044W, YMR321C, YKL153W, YMR195W, YHL015W, YNL096C, YGR030C, YDR123C, YKL186C, YOR234C, YKL001C, YJL188C, YDL023C, YPL143W, YEL039C, YKL006W, YGR280C, YBR285W, YKR091W, YDR064W, YBR047W, YGR243W, YOR309C, YDR461W, YHR053C, YHR055C, YGR148C, YGL187C, YIL018W, YFR003C, YPL107W, YBR185C, YNR014W, YJL067W, YDR451C, YGL031C, YHR141C, YNL162W, YBR046C, YNL036W, YDL136W, YDL191W, YLR257W, YNL057W, YGL068W, YKR057W, YLR201C, YHL001W, YDR010C, YPL138C, YOR312C, YPL276W, YML114C, YLR327C, YBR191W, YOR257W, YOR096W, YPL223C, YJL136C, YAL044C, YER079W, YMR107W, YPL079W, YDR175C, YGR035C, YDR153C, YDR337W, YOR167C, YMR194W, YOR194C, YHR090C, YGR110W, YMR242C, YHR198C, YPL177C, YLR164W, YMR143W, YDL083C, YLR325C, YOR203W, YMR193W, YLR062C, YOR383C, YLR300W, YJL079C, YJL158C, YHR139C, YGL032C, YER150W, YNL160W, YDR382W, YMR305C, YKL096W, YKR013W, YCL043C, YLR042C, YDR055W, YPL163C, YEL040W, YJL171C, YLR121C, YDR382W, YLR250W, YGR189C, YJL159W, YMR215W, YDR519W, YIL162W, YKL163W, YDR518W, YDR534C, YPR157W, YML130C, YML128C, YBR092C, YDR032C, YLR120C, YBR093C, YHR215W, YAR071W, YDL130W, YDR144C, YPR123C, YGR174C, YOR327C, YNL058C, YGR265W, YGR160W, YIL117C, YOL053W, YGR236C, YGR060W, YKL120W, YDL046W, YHR132C, YMR058W, YLR332W, YKR061W, YEL001C, YKL154W, YKL073W, YMR238W, YJR020W, YIL136W, YHL028W, YDL010W, YLR339C, YNL217W, YHR063C.

The different knockout strains can be thought of as analogous to genetic disease mutants. Accordingly, these data further support the notion that each disease has a unique expression fingerprint and that each disease generates unique collections of secreted proteins that constitute molecular fingerprints capable of identifying the corresponding disease.

Example 7

Identification of Prostate-Specific/Enriched Genes Using a 2.5 Fold Over-Expression Cut-Off Organ specific/enriched expression can be determined by the ratio of the expression (e.g., measured in transcripts per million (tpm)) in a particular organ as compared to other organs. In this example, prostate enriched/specific expression was analyzed by comparing the expression level (tpm counts) of MPSS signature sequences identified from normal prostate tissue to their corresponding expression levels in 33 normal tissues. A particular gene that demonstrated at least a 2.5-fold increase in expression in prostate as compared to all tissues examined (each tissue evaluated individually) was considered to be prostate-specific/enriched. The tissues examined were adrenal gland, bladder, bone marrow, brain (amygdala, caudate nucleus, cerebellum, corpus callosum, hypothalamus, and thalamus), whole fetal brain, heart, kidney, liver (new cloning), lung, mammary gland, monocytes, peripheral blood lymphocytes, pituitary gland, placenta, pancreas, prostate, retina, spinal cord, salivary gland, small intestine, stomach, spleen, testis, thymus, trachea, thyroid, and uterus. This analysis identified 109 unique genes (with mpss signature sequence belonging to class 1-4, i.e. with confirmed match to cDNAs) whose expression was at least 2.5 fold that observed in other normal tissues. The list of prostate-specific/enriched genes is provided in Tables 5A-5D with the expression level in tpm in prostate shown. This list includes KLK2, KLK3, KLK4, TMPRSS2, which are genes previously shown to be prostate-specific.

TABLE 5A

PROSTATE ENRICHED GENES IDENTIFIED BY RATIO SCHEMA (RATIO >2.5)*

| MPSS Signature | MPSS Sig. SEQ ID NO: | Name | Genbank Accession No. | Genbank SEQ ID NOs: | Tissue Names Description |
|---|---|---|---|---|---|
| GATCTCAGAACAACCTT | 1688 | DHRS7 | BC000637 | 1797-1798 | Dehydrogenase/reductase (SDR family) member 7 |
| GATCCAGCCCAGAGACA | 1689 | NPY | BC029497 | 1799-1800 | Neuropeptide Y |
| GATCACTCCTTATTTGC | 1690 | FLJ20010 | AW172826 | 1801 | Hypothetical protein FLJ20010 |
| GATCCCTCTCCTCTCTG | 1691 | C9orf61 | BI771919 | 1802 | Chromosome 9 open reading frame 61 |
| GATCTGACTTTTTACTT | 1692 | Lrp2bp | BU853306 | 1803 | Ankyrin repeat domain 37 |
| GATCGTTAGCCTCATAT | 1693 | HOXB13 | BC007092 | 1804-1805 | Homeo box B13 |
| GATCACAAGGAATCCTG | 1694 | CREB3L4 | BC038962 | 1806-1807 | CAMP responsive element binding protein 3-like 4 |
| GATCTCATGGATGATTA | 1695 | LEPREL1 | BC005029 | 1808-1809 | Leprecan-like 1 |
| GATCCAGAAATAAAGTC | 1696 | KLK4 | CB051271 | 1810 | Kallikrein 4 (protease, enamel matrix, prostate) |
| GATCTCACAGAAGATGT | 1697 | MGC35558 | NM_145013 | 1811-1812 | Chromosome 11 open reading frame 45 |
| GATCCAAAATCACCAAG | 1698 | HAX1 | BU157155 | 1813 | HCLS1 associated protein X-1 |
| GATCCTGGGCTGGAAGG | 1699 | 0 | AW207206 | 1814 | Hypothetical gene supported by AY338954 |
| GATCCAGATGCAGGACT | 1700 | 0 | BC013389 | 1815 | LOC440156 |
| GATCTGTGCTCATCTGT | 1701 | TMEM16G | BC028162 | 1816-1817 | Transmembrane protein 16G |
| GATCATTTTATATCAAT | 1702 | MGC31963 | BX099160 | 1818 | Chromosome 1 open reading frame 85 |
| GATCCACACTGAGAGAG | 1703 | KLK3 | BC005307 | 1819-1820 | Kallikrein 3, (prostate specific antigen) |
| GATCCGTCTGTGCACAT | 1704 | TMPRSS2 | NM_005656 | 1821-1822 | Transmembrane protease, serine 2 |
| GATCATTGTAGGGTAAC | 1705 | LOC221442 | BC026923 | 1823 | Hypothetical protein LOC221442 |
| GATCAGCCCTCAAAAAA | 1706 | ARL10C | BU159800 | 1824 | ADP-ribosylation factor-like 8B |
| GATCTGGATTCAGGACC | 1707 | MGC13102 | NM_032323 | 1825-1826 | Hypothetical protein MGC13102 |
| GATCAAAAATAAAATGT | 1708 | 0 | AI954252 | 1827 | Hypothetical gene supported by AK022914; AK095211; BC016035; BC041856; BX248778 |
| GATCCGCTCTGGTCAAC | 1709 | SEPX1 | BQ941313 | 1828 | Selenoprotein X, 1 |
| GATCCCTCAAGACTGGT | 1710 | ACPP | BC007460 | 1829-1830 | Acid phosphatase, prostate |
| GATCCACAAAGACGAGG | 1711 | BIN3 | BI911790 | 1831 | Bridging integrator 3 |
| GATCTCTCTGCGTTTGA | 1712 | SPON2 | BC002707 | 1832-1833 | Spondin 2, extracellular matrix protein |
| GATCTCAACCTCGCTTG | 1713 | 0 | AK026938 | 1834 | Hypothetical gene supported by AL713796 |
| GATCAAGTTCCCGCTGG | 1714 | RPL18A | BG818587 | 1835 | Ribosomal protein L18a |

TABLE 5A-continued

PROSTATE ENRICHED GENES IDENTIFIED BY RATIO SCHEMA (RATIO >2.5)*

| MPSS Signature | MPSS Sig. SEQ ID NO: | Name | Genbank Accession No. | Genbank SEQ ID NOs: | Tissue Names Description |
|---|---|---|---|---|---|
| GATCATAATGAGGTTTG | 1715 | ABCC4 | NM_005845 | 1836-1837 | ATP-binding cassette, sub-family C (CFTR/MRP), member 4 |
| GATCGGTGACATCGTAA | 1716 | RPS11 | AA888242 | 1838 | Ribosomal protein S11 |
| GATCCACCAGCTGATAA | 1717 | NSEP1 | CN353139 | 1839 | Y box binding protein 1 |
| GATCAACACACTTTATT | 1718 | FLJ22955 | AA256381 | 1840 | Hypothetical protein FLJ22955 |
| GATCCCTTCCTTCCTCT | 1719 | HOXD11 | AA513505 | 1841 | Homeo box D11 |
| GATCAGGACACAGACTT | 1720 | ORM1 | BG564253 | 1842 | Orosomucoid 1 |
| GATCCTGCAATCTTGTA | 1721 | HTPAP | AI572087 | 1843 | Phosphatidic acid phosphatase type 2 domain containing 1B |
| GATCCTCCTATGTTGTT | 1722 | KLK2 | AA259243 | 1844 | Kallikrein 2, prostatic |
| GATCTGTACCTTGGCTA | 1723 | SLC2A12 | AI675682 | 1845 | Solute carrier family 2 (facilitated glucose transporter), member 12 |
| GATCGGGGCAAGAGAGG | 1724 | NDRG1 | NM_006096 | 1846-1847 | N-myc downstream regulated gene 1 |
| GATCCCCTCCCCTCCCC | 1725 | NPR1 | NM_000906 | 1848-1849 | Natriuretic peptide receptor A/guanylate cyclase A (atrionatriuretic peptide receptor A) |
| GATCCTACAAAGAAGGA | 1726 | FLJ21511 | NM_025087 | 1850-1851 | Hypothetical protein FLJ21511 |
| GATCATTTGCAGTTAAG | 1727 | FOXA1 | NM_004496 | 1852-1853 | Forkhead box A1 |
| GATCTGTCTCCTGCTCT | 1728 | ENPP3 | AI535878 | 1854 | Ectonucleotide pyrophosphatase/phosphodiesterase 3 |
| GATCCTTCCCAAGGTAC | 1729 | GATA2 | NM_032638 | 1855-1856 | GATA binding protein 2 |
| GATCTTGTTGAAGTCAA | 1730 | ARG2 | BX331427 | 1857 | Arginase, type II |
| GATCGCACCACTGTACA | 1731 | XPO1 | AI569484 | 1858 | Exportin 1 (CRM1 homolog, yeast) |
| GATCATTTTCTGCTTTA | 1732 | ASB3 | BC009569 | 1859-1860 | Ankyrin repeat and SOCS box-containing 3 |
| GATCCCCACACTTGTCC | 1733 | 0 | AK000028 | 1861 | Hypothetical LOC90024 |
| GATCTGGAATTGTCATA | 1734 | KLF3 | BX100634 | 1862 | Kruppel-like factor 3 (basic) |
| GATCAATAAGCTTTAAA | 1735 | TGM4 | BC007003 | 1863-1864 | Transglutaminase 4 (prostate) |
| GATCAATGTTTGTAGAT | 1736 | FLJ16231 | NM_001008401 | 1865-1866 | FLJ16231 protein |
| GATCTACATGTCTATCA | 1737 | BLNK | BX113323 | 1867 | B-cell linker |
| GATCTGTTTTAAATGAG | 1738 | SLC14A1 | NM_015865 | 1868-1869 | Solute carrier family 14 (urea transporter), member 1 (Kidd blood group) |
| GATCAAAAAATGCTGCA | 1739 | PTPLB | AI017286 | 1870 | Protein tyrosine phosphatase-like (proline instead of catalytic arginine), member b |
| GATCATGTCTTCATTTT | 1740 | OR51E2 | NM_030774 | 1871-1872 | Olfactory receptor, family 51, subfamily E, member 2 |
| GATCCCTCCACCCCCAT | 1741 | FAAH | NM_001441 | 1873-1874 | Fatty acid amide hydrolase |
| GATCCTAAGCCATAAAT | 1742 | STAT6 | AL044554 | 1875 | Signal transducer and activator of transcription 6, interleukin-4 induced |
| GATCATCGTCCTCATCG | 1743 | ANKH | CB049466 | 1876 | Ankylosis, progressive homolog (mouse) |
| GATCATCATTTGTCATT | 1744 | DSCR1L2 | AW575747 | 1877 | Down syndrome critical region gene 1-like 2 |
| GATCTAATTTGAAAAAC | 1745 | TRPM8 | NM_024080 | 1878-1879 | Transient receptor potential cation channel, subfamily M, member 8 |
| GATCTTCCTTGTATCAT | 1746 | TMC4 | AV724505 | 1880 | Transmembrane channel-like 4 |
| GATCTCCCCCATGCCTG | 1747 | ZNF589 | BC005859 | 1881-1882 | Zinc finger protein 589 |
| GATCAAATTTAGTATTT | 1748 | LRRK1 | BC005408 | 1883-1884 | Leucine-rich repeat kinase 1 |
| GATCTGCCTTATAAACA | 1749 | STEAP2 | AA177004 | 1885 | Six transmembrane epithelial antigen of the prostate 2 |
| GATCAGAAAATGAGCTC | 1750 | SAFB2 | BC001216 | 1886 | Scaffold attachment factor B2 |
| GATCACCGTGGAGGTTA | 1751 | CPE | BG707154 | 1887 | Carboxypeptidase E |
| GATCCCTCTGTGCTTCT | 1752 | GNB2L1 | AA024878 | 1888 | Guanine nucleotide binding protein (G protein), beta polypeptide 2-like 1 |
| GATCTCATTTTAGAGC | 1753 | LOC92689 | BU688574 | 1889 | Hypothetical protein BC001096 |
| GATCATCACATTTCGTG | 1754 | DLG1 | BC042118 | 1890 | Discs, large homolog 1 (*Drosophila*) |
| GATCATTTCTGCTTCA | 1755 | SEMG1 | NM_003007 | 1891-1892 | Semenogelin I |
| GATCAATGAAGGAGAGA | 1756 | SPATA13 | BM875598 | 1893 | Spermatogenesis associated 13 |
| GATCCCAACTACTCGGG | 1757 | LOC157657 | NM_177965 | 1894-1895 | Chromosome 8 open reading frame 37 |
| GATCAGTTTTTCTGTAA | 1758 | KIAA1411 | CA433208 | 1896 | KIAA1411 |
| GATCAAAATTTTAAAAA | 1759 | MGC20781 | BM984931 | 1897 | 5'-nucleotidase, cytosolic III-like |

TABLE 5A-continued

PROSTATE ENRICHED GENES IDENTIFIED BY RATIO SCHEMA (RATIO >2.5)*

| MPSS Signature | MPSS Sig. SEQ ID NO: | Name | Genbank Accession No. | Genbank SEQ ID NOs: | Tissue Names Description |
|---|---|---|---|---|---|
| GATCACCCTTCTCTTCC | 1760 | LOC255189 | BC035335 | 1898-1899 | Phospholipase A2, group IVF |
| GATCCTGGGTACTGAAA | 1761 | ERBB2 | BC080193 | 1900 | V-erb-b2 erythroblastic leukemia viral oncogene homolog 2, neuro/glioblastoma derived oncogene homolog (avian) |
| GATCGTTCTAAGAGTGT | 1762 | ZFP64 | NM_199427 | 1901-1902 | Zinc finger protein 64 homolog (mouse) |
| GATCATCATCAAGGGCT | 1763 | SUHW2 | BC042370 | 1903 | Suppressor of hairy wing homolog 2 (*Drosophila*) |
| GATCAAAATGATTTTCA | 1764 | ELOVL7 | AL137506 | 1904-1905 | ELOVL family member 7, elongation of long chain fatty acids (yeast) |
| GATCTGATTTTTTTCCC | 1765 | TRAF4 | AI888175 | 1906 | TNF receptor-associated factor 4 |
| GATCCCATTTCTCACCC | 1766 | SLC39A2 | AI669751 | 1907 | Solute carrier family 39 (zinc transporter), member 2 |
| GATCCTCCCGCCTTGCC | 1767 | HNF4G | AI088739 | 1908 | Hepatocyte nuclear factor 4, gamma |
| GATCTTTCTTTTTTTGT | 1768 | SLC22A3 | BC070300 | 1909 | Solute carrier family 22 (extraneuronal monoamine transporter), member 3 |
| GATCTTAACTGTCTCCT | 1769 | HIST2H2BE | BC005827 | 1910 | Histone 2, H2be |
| GATCAGTTTGATTCTGT | 1770 | AMD1 | BC041345 | 1911-1912 | Adenosylmethionine decarboxylase 1 |
| GATCATGATGTAGAGGG | 1771 | TYMS | BX390036 | 1913 | Thymidylate synthetase |
| GATCGCACCACTACAGT | 1772 | PHC3 | AK022455 | 1914 | Polyhomeotic like 3 (*Drosophila*) |
| GATCTCAAAGTGCCTTC | 1773 | SARG | AL832940 | 1915-1916 | Chromosome 1 open reading frame 116 |
| GATCAATGTCAAACTTC | 1774 | MTERF | BC000965 | 1917-1918 | Mitochondrial transcription termination factor |
| GATCTCCCAGAGTCTAA | 1775 | CYP4F8 | NM_007253 | 1919-1920 | Cytochrome P450, family 4, subfamily F, polypeptide 8 |
| GATCCTGATGGCTGTGT | 1776 | PPAP2A | AK124401 | 1921 | Phosphatidic acid phosphatase type 2A |
| GATCACTTCCCGCAGTC | 1777 | KIAA0056 | BC011408 | 1922-1923 | KIAA0056 protein |
| GATCTCAAAGGAACCAA | 1778 | MSMB | AA469293 | 1924 | Microseminoprotein, beta- |
| GATCTGTGCCAGGGTTA | 1779 | VEGF | AK056914 | 1925 | Vascular endothelial growth factor |
| GATCTCTTTTTATTTAA | 1780 | CDH1 | NM_004360 | 1926-1927 | Cadherin 1, type 1, E-cadherin (epithelial) |
| GATCTCCAGCACCAATC | 1781 | TARP | BC062761 | 1928-1929 | TCR gamma alternate reading frame protein |
| GATCTGGCGCTTGGGGG | 1782 | RFP2 | NM_001007278 | 1930-1931 | Ret finger protein 2 |
| GATCCCGACGGGGGCAT | 1783 | MESP1 | NM_018670 | 1932-1933 | Mesoderm posterior 1 homolog (mouse) |
| GATCCCGGGCCGTTATC | 1784 | TRPM4 | AA026974 | 1934 | Transient receptor potential cation channel, subfamily M, member 4 |
| GATCTTTCTCAAAATAT | 1785 | PAK1IP1 | AI468032 | 1935 | PAK1 interacting protein 1 |
| GATCGTGACGCTTAATA | 1786 | HNRPA1 | CF122297 | 1936 | Heterogeneous nuclear ribonucleoprotein A1 |
| GATCGCATAATTTTTAA | 1787 | ZNF207 | CB053869 | 1937 | Zinc finger protein 207 |
| GATCCCAACACTGAAGG | 1788 | WNK4 | NM_032387 | 1938-1939 | WNK lysine deficient protein kinase 4 |
| GATCTTAAAAACTGCAG | 1789 | APXL2 | BQ448015 | 1940 | Apical protein 2 |
| GATCATTTTTTCTATCA | 1790 | MED28 | AI554477 | 1941 | Mediator of RNA polymerase II transcription, subunit 28 homolog (yeast) |
| GATCCCATTGTGTGTAT | 1791 | LOC285300 | AK095655 | 1942 | Hypothetical protein LOC285300 |
| GATCTCAAAGGAAAAAA | 1792 | 0 | AW291753 | 1943 | Transcribed locus |
| GATCTTCTGTTATATTT | 1793 | 0 | BM023121 | 1944 | Full length insert cDNA clone ZD79H10 |
| GATCCACAACATACAGC | 1794 | 0 | AY338953 | 1945 | Prostate-specific P712P mRNA sequence |
| GATCTGTGCAGTTGTAA | 1795 | 0 | AY533562 | 1946 | KLK16 mRNA, partial sequence |
| GATCTACTATGCCAAAT | 1796 | 0 | BC030554 | 1947 | (clone HGT25) T cell receptor gamma-chain mRNA, V region |

*ratio of prostate expression in tpm to other organs greater than 2.5

TABLE 5B

PROSTATE ENRICHED GENES IDENTIFIED BY RATIO SCHEMA (RATIO > 2.5)*

| Genbank Accession No. | Genbank SEQ ID NOs: | Name | SignalP3.0 prediction Prediction | SignalP3.0 prediction Signal peptide probability |
|---|---|---|---|---|
| BC000637 | 1797-1798 | DHRS7 | Signal peptide | 0.999 |
| BC029497 | 1799-1800 | NPY | Signal peptide | 0.998 |
| AW172826 | 1801 | FLJ20010 | Non-secretory protein | 0.001 |
| BI771919 | 1802 | C9orf61 | Signal peptide | 0.994 |
| BU853306 | 1803 | Lrp2bp | Non-secretory protein | 0 |
| BC007092 | 1804-1805 | HOXB13 | Non-secretory protein | 0 |
| BC038962 | 1806-1807 | CREB3L4 | Non-secretory protein | 0 |
| BC005029 | 1808-1809 | LEPREL1 | Signal peptide | 0.995 |
| CB051271 | 1810 | KLK4 | Signal peptide | 0.988 |
| NM_145013 | 1811-1812 | MGC35558 | Signal peptide | 0.935 |
| BU157155 | 1813 | HAX1 | Non-secretory protein | 0.001 |
| AW207206 | 1814 | 0 | Non-secretory protein | 0.001 |
| BC013389 | 1815 | 0 | Non-secretory protein | 0 |
| BC028162 | 1816-1817 | TMEM16G | Non-secretory protein | 0.001 |
| BX099160 | 1818 | MGC31963 | Signal peptide | 0.994 |
| BC005307 | 1819-1820 | KLK3 | Signal peptide | 0.992 |
| NM_005656 | 1821-1822 | TMPRSS2 | Non-secretory protein | 0 |
| BC026923 | 1823 | LOC221442 | Signal anchor | 0.01 |
| BU159800 | 1824 | ARL10C | Non-secretory protein | 0 |
| NM_032323 | 1825-1826 | MGC13102 | Non-secretory protein | 0 |
| AI954252 | 1827 | 0 | Non-secretory protein | 0.128 |
| BQ941313 | 1828 | SEPX1 | Non-secretory protein | 0 |
| BC007460 | 1829-1830 | ACPP | Signal peptide | 1 |
| BI911790 | 1831 | BIN3 | Non-secretory protein | 0 |
| BC002707 | 1832-1833 | SPON2 | Signal peptide | 0.998 |
| AK026938 | 1834 | 0 | Signal peptide | 0.587 |
| BG818587 | 1835 | RPL18A | Non-secretory protein | 0 |
| NM_005845 | 1836-1837 | ABCC4 | Non-secretory protein | 0 |
| AA888242 | 1838 | RPS11 | Non-secretory protein | 0 |
| CN353139 | 1839 | NSEP1 | Non-secretory protein | 0.001 |
| CA256381 | 1840 | FLJ22955 | Non-secretory protein | 0.06 |
| AA513505 | 1841 | HOXD11 | Non-secretory protein | 0 |
| BG564253 | 1842 | ORM1 | Signal peptide | 1 |
| AI572087 | 1843 | HTPAP | Non-secretory protein | 0.021 |
| AA259243 | 1844 | KLK2 | Signal peptide | 0.985 |
| AI675682 | 1845 | SLC2A12 | Non-secretory protein | 0 |
| NM_006096 | 1846-1847 | NDRG1 | Non-secretory protein | 0 |
| NM_000906 | 1848-1849 | NPR1 | Signal peptide | 0.997 |
| NM_025087 | 1850-1851 | FLJ21511 | Non-secretory protein | 0.005 |
| NM_004496 | 1852-1853 | FOXA1 | Non-secretory protein | 0 |
| AI535878 | 1854 | ENPP3 | Non-secretory protein | 0.069 |
| NM_032638 | 1855-1856 | GATA2 | Non-secretory protein | 0 |
| BX331427 | 1857 | ARG2 | Non-secretory protein | 0.014 |
| AI569484 | 1858 | XPO1 | Non-secretory protein | 0 |
| BC009569 | 1859-1860 | ASB3 | Non-secretory protein | 0 |
| AK000028 | 1861 | 0 | Non-secretory protein | 0.001 |
| BX100634 | 1862 | KLF3 | Non-secretory protein | 0 |
| BC007003 | 1863-1864 | TGM4 | Non-secretory protein | 0 |
| NM_001008401 | 1865-1866 | FLJ16231 | Non-secretory protein | 0 |
| BX113323 | 1867 | BLNK | Non-secretory protein | 0 |
| NM_015865 | 1868-1869 | SLC14A1 | Non-secretory protein | 0 |
| AI017286 | 1870 | PTPLB | Non-secretory protein | 0.06 |
| NM_030774 | 1871-1872 | OR51E2 | Non-secretory protein | 0.008 |
| NM_001441 | 1873-1874 | FAAH | Signal peptide | 0.805 |
| AL044554 | 1875 | STAT6 | Non-secretory protein | 0 |
| CB049466 | 1876 | ANKH | Non-secretory protein | 0.001 |
| AW575747 | 1877 | DSCR1L2 | Non-secretory protein | 0 |
| NM_024080 | 1878-1879 | TRPM8 | Non-secretory protein | 0 |
| AV724505 | 1880 | TMC4 | Non-secretory protein | 0 |
| BC005859 | 1881-1882 | ZNF589 | Non-secretory protein | 0 |
| BC005408 | 1883-1884 | LRRK1 | Non-secretory protein | 0 |
| AA177004 | 1885 | STEAP2 | Non-secretory protein | 0 |
| BC001216 | 1886 | SAFB2 | Non-secretory protein | 0 |
| BG707154 | 1887 | CPE | Signal peptide | 1 |
| AA024878 | 1888 | GNB2L1 | Non-secretory protein | 0 |
| BU688574 | 1889 | LOC92689 | Non-secretory protein | 0 |
| BC042118 | 1890 | DLG1 | Non-secretory protein | 0 |
| NM_003007 | 1891-1892 | SEMG1 | Signal peptide | 0.922 |
| BM875598 | 1893 | SPATA13 | Non-secretory protein | 0 |
| NM_177965 | 1894-1895 | LOC157657 | Non-secretory protein | 0 |
| CA433208 | 1896 | KIAA1411 | Non-secretory protein | 0 |
| BM984931 | 1897 | MGC20781 | Non-secretory protein | 0 |
| BC035335 | 1898-1899 | LOC255189 | Non-secretory protein | 0 |

TABLE 5B-continued

PROSTATE ENRICHED GENES IDENTIFIED BY RATIO SCHEMA (RATIO > 2.5)*

| Genbank Accession No. | Genbank SEQ ID NOs: | Name | SignalP3.0 prediction Prediction | SignalP3.0 prediction Signal peptide probability |
|---|---|---|---|---|
| BC080193 | 1900 | ERBB2 | Non-secretory protein | 0 |
| NM_199427 | 1901-1902 | ZFP64 | Non-secretory protein | 0 |
| BC042370 | 1903 | SUHW2 | Non-secretory protein | 0 |
| AL137506 | 1904-1905 | ELOVL7 | Non-secretory protein | 0 |
| AI888175 | 1906 | TRAF4 | Non-secretory protein | 0 |
| AI669751 | 1907 | SLC39A2 | Signal peptide | 0.982 |
| AI088739 | 1908 | HNF4G | Non-secretory protein | 0.001 |
| BC070300 | 1909 | SLC22A3 | Signal anchor | 0.097 |
| BC005827 | 1910 | HIST2H2BE | Non-secretory protein | 0 |
| BC041345 | 1911-1912 | AMD1 | Non-secretory protein | 0 |
| BX390036 | 1913 | TYMS | Non-secretory protein | 0 |
| AK022455 | 1914 | PHC3 | Non-secretory protein | 0 |
| AL832940 | 1915-1916 | SARG | Non-secretory protein | 0 |
| BC000965 | 1917-1918 | MTERF | Non-secretory protein | 0 |
| NM_007253 | 1919-1920 | CYP4F8 | Signal peptide | 1 |
| AK124401 | 1921 | PPAP2A | Non-secretory protein | 0.348 |
| BC011408 | 1922-1923 | KIAA0056 | Non-secretory protein | 0 |
| AA469293 | 1924 | MSMB | Signal peptide | 0.997 |
| AK056914 | 1925 | VEGF | Non-secretory protein | 0 |
| NM_004360 | 1926-1927 | CDH1 | Signal peptide | 0.896 |
| BC062761 | 1928-1929 | TARP | Non-secretory protein | 0 |
| NM_001007278 | 1930-1931 | RFP2 | Non-secretory protein | 0 |
| NM_018670 | 1932-1933 | MESP1 | Signal anchor | 0.004 |
| AA026974 | 1934 | TRPM4 | Non-secretory protein | 0 |
| AI468032 | 1935 | PAK1IP1 | Non-secretory protein | 0.001 |
| CF122297 | 1936 | HNRPA1 | Non-secretory protein | 0 |
| CB053869 | 1937 | ZNF207 | Non-secretory protein | 0 |
| NM_032387 | 1938-1939 | WNK4 | Non-secretory protein | 0 |
| BQ448015 | 1940 | APXL2 | Non-secretory protein | 0 |
| AI554477 | 1941 | MED28 | | |
| AK095655 | 1942 | LOC285300 | | |
| AW291753 | 1943 | 0 | | |
| BM023121 | 1944 | 0 | | |
| AY338953 | 1945 | 0 | | |
| AY533562 | 1946 | 0 | | |
| BC030554 | 1947 | 0 | | |

*ratio of prostate expression in tpm to other organs greater than 2.5

TABLE 5C

PROSTATE ENRICHED GENES IDENTIFIED BY RATIO SCHEMA (RATIO > 2.5)*

| Genbank Accession No. | Genbank SEQ ID NOs: | name | SignalP3.0 prediction Max cleavage site probability | SecretomeP2.0 prediction Secreted potential (Odds) | TMHMM 2.0 prediction Pred trans-membrane domains |
|---|---|---|---|---|---|
| BC000637 | 1797-1798 | DHRS7 | 0.599 between pos. 28 and 29 | 6.3 | 1 |
| BC029497 | 1799-1800 | NPY | 0.520 between pos. 28 and 29 | 6.09 | 1 |
| AW172826 | 1801 | FLJ20010 | 0.000 between pos. 46 and 47 | 6.06 | 0 |
| BI771919 | 1802 | C9orf61 | 0.534 between pos. 29 and 30 | 5.9 | 2 |
| BU853306 | 1803 | Lrp2bp | 0.000 between pos. 55 and 56 | 5.62 | 0 |
| BC007092 | 1804-1805 | HOXB13 | 0.000 between pos. −1 and 0 | 5.14 | 0 |
| BC038962 | 1806-1807 | CREB3L4 | 0.000 between pos. −1 and 0 | 4.72 | 0 |
| BC005029 | 1808-1809 | LEPREL1 | 0.991 between pos. 24 and 25 | 4.59 | 0 |
| CB051271 | 1810 | KLK4 | 0.401 between pos. 29 and 30 | 4.57 | 1 |
| NM_145013 | 1811-1812 | MGC35558 | 0.901 between pos. 22 and 23 | 4.47 | 0 |
| BU157155 | 1813 | HAX1 | 0.001 between pos. 18 and 19 | 4.41 | 0 |

TABLE 5C-continued

PROSTATE ENRICHED GENES IDENTIFIED BY RATIO SCHEMA (RATIO > 2.5)*

| Genbank Accession No. | Genbank SEQ ID NOs: | name | SignalP3.0 prediction Max cleavage site probability | SecretomeP2.0 prediction Secreted potential (Odds) | TMHMM 2.0 prediction Pred trans-membrane domains |
|---|---|---|---|---|---|
| AW207206 | 1814 | 0 | 0.001 between pos. 20 and 21 | 4.39 | 0 |
| BC013389 | 1815 | 0 | 0.000 between pos. 27 and 28 | 4.3 | 0 |
| BC028162 | 1816-1817 | TMEM16G | 0.001 between pos. 22 and 23 | 4.29 | 7 |
| BX099160 | 1818 | MGC31963 | 0.855 between pos. 35 and 36 | 4.22 | 2 |
| BC005307 | 1819-1820 | KLK3 | 0.525 between pos. 23 and 24 | 3.938 | 0 |
| NM_005656 | 1821-1822 | TMPRSS2 | 0.000 between pos. −1 and 0 | 3.86 | 1 |
| BC026923 | 1823 | LOC221442 | 0.004 between pos. 50 and 51 | 3.81 | 0 |
| BU159800 | 1824 | ARL10C | 0.000 between pos. 35 and 36 | 3.76 | 0 |
| NM_032323 | 1825-1826 | MGC13102 | 0.000 between pos. −1 and 0 | 3.69 | 5 |
| AI954252 | 1827 | 0 | 0.121 between pos. 42 and 43 | 3.58 | 0 |
| BQ941313 | 1828 | SEPX1 | 0.000 between pos. 13 and 14 | 3.49 | 0 |
| BC007460 | 1829-1830 | ACPP | 0.975 /between pos. 32 and 33 | 3.49 | 1 |
| BI911790 | 1831 | BIN3 | 0.000 between pos. −1 and 0 | 3.41 | 0 |
| BC002707 | 1832-1833 | SPON2 | 0.829 between pos. 26 and 27 | 3.06 | 0 |
| AK026938 | 1834 | 0 | 0.568 between pos. 27 and 28 | 3.02 | 0 |
| BG818587 | 1835 | RPL18A | 0.000 between pos. 24 and 25 | 2.8 | 0 |
| NM_005845 | 1836-1837 | ABCC4 | 0.000 between pos. −1 and 0 | 2.67 | 11 |
| AA888242 | 1838 | RPS11 | 0.000 between pos. −1 and 0 | 2.64 | 0 |
| CN353139 | 1839 | NSEP1 | 0.000 between pos. 25 and 26 | 2.35 | 0 |
| AA256381 | 1840 | FLJ22955 | 0.038 between pos. 15 and 16 | 2.19 | 1 |
| AA513505 | 1841 | HOXD11 | 0.000 between pos. 20 and 21 | 2.14 | 0 |
| BG564253 | 1842 | ORM1 | 0.923 between pos. 18 and 19 | 2.03 | 0 |
| AI572087 | 1843 | HTPAP | 0.009 between pos. 63 and 64 | 2.01 | 4 |
| AA259243 | 1844 | KLK2 | 0.455 between pos. 17 and 18 | 1.81 | 0 |
| AI675682 | 1845 | SLC2A12 | 0.000 between pos. 51 and 52 | 1.79 | 12 |
| NM_006096 | 1846-1847 | NDRG1 | 0.000 between pos. −1 and 0 | 1.76 | 0 |
| NM_000906 | 1848-1849 | NPR1 | 0.960 between pos. 32 and 33 | 1.75 | 0 |
| NM_025087 | 1850-1851 | FLJ21511 | 0.005 between pos. 20 and 21 | 1.75 | 10 |
| NM_004496 | 1852-1853 | FOXA1 | 0.000 between pos. −1 and 0 | 1.71 | 0 |
| AI535878 | 1854 | ENPP3 | 0.036 between pos. 42 and 43 | 1.69 | 1 |
| NM_032638 | 1855-1856 | GATA2 | 0.000 between pos. 22 and 23 | 1.65 | 0 |
| BX331427 | 1857 | ARG2 | 0.013 between pos. 36 and 37 | 1.56 | 0 |
| AI569484 | 1858 | XPO1 | 0.000 between pos. −1 and 0 | 1.54 | 0 |
| BC009569 | 1859-1860 | ASB3 | 0.000 between pos. −1 and 0 | 1.53 | 0 |
| AK000028 | 1861 | 0 | 0.000 between pos. 22 and 23 | 1.46 | 0 |
| BX100634 | 1862 | KLF3 | 0.000 between pos. −1 and 0 | 1.4 | 0 |

TABLE 5C-continued

PROSTATE ENRICHED GENES IDENTIFIED BY RATIO SCHEMA (RATIO > 2.5)*

| Genbank Accession No. | Genbank SEQ ID NOs: | name | SignalP3.0 prediction Max cleavage site probability | SecretomeP2.0 prediction Secreted potential (Odds) | TMHMM 2.0 prediction Pred trans- membrane domains |
|---|---|---|---|---|---|
| BC007003 | 1863-1864 | TGM4 | 0.000 between pos. −1 and 0 | 1.36 | 0 |
| NM_001008401 | 1865-1866 | FLJ16231 | 0.000 between pos. −1 and 0 | 1.21 | 0 |
| BX113323 | 1867 | BLNK | 0.000 between pos. −1 and 0 | 1.21 | 0 |
| NM_015865 | 1868-1869 | SLC14A1 | 0.000 between pos. −1 and 0 | 1.2 | 8 |
| AI017286 | 1870 | PTPLB | 0.028 between pos. 63 and 64 | 1.2 | 4 |
| NM_030774 | 1871-1872 | OR51E2 | 0.003 between pos. 22 and 23 | 1.2 | 7 |
| NM_001441 | 1873-1874 | FAAH | 0.549 between pos. 28 and 29 | 1.2 | 1 |
| AL044554 | 1875 | STAT6 | 0.000 between pos. −1 and 0 | 1.17 | 0 |
| CB049466 | 1876 | ANKH | 0.000 between pos. 26 and 27 | 1.15 | 8 |
| AW575747 | 1877 | DSCR1L2 | 0.000 between pos. −1 and 0 | 1.12 | 0 |
| NM_024080 | 1878-1879 | TRPM8 | 0.000 between pos. −1 and 0 | 1.07 | 8 |
| AV724505 | 1880 | TMC4 | 0.000 between pos. −1 and 0 | 1.06 | 8 |
| BC005859 | 1881-1882 | ZNF589 | 0.000 between pos. −1 and 0 | 0.99 | 1 |
| BC005408 | 1883-1884 | LRRK1 | 0.000 between pos. −1 and 0 | 0.99 | 0 |
| AA177004 | 1885 | STEAP2 | 0.000 between pos. −1 and 0 | 0.95 | 6 |
| BC001216 | 1886 | SAFB2 | 0.000 between pos. −1 and 0 | 0.95 | 0 |
| BG707154 | 1887 | CPE | 0.859 between pos. 27 and 28 | 0.93 | 0 |
| AA024878 | 1888 | GNB2L1 | 0.000 between pos. 33 and 34 | 0.92 | 0 |
| BU688574 | 1889 | LOC92689 | 0.000 between pos. −1 and 0 | 0.91 | 0 |
| BC042118 | 1890 | DLG1 | 0.000 between pos. −1 and 0 | 0.87 | 0 |
| NM_003007 | 1891-1892 | SEMG1 | 0.515 between pos. 23 and 24 | 0.85 | 0 |
| BM875598 | 1893 | SPATA13 | 0.000 between pos. −1 and 0 | 0.81 | 0 |
| NM_177965 | 1894-1895 | LOC157657 | 0.000 between pos. −1 and 0 | 0.81 | 0 |
| CA433208 | 1896 | KIAA1411 | 0.000 between pos. −1 and 0 | 0.8 | 0 |
| BM984931 | 1897 | MGC20781 | 0.000 between pos. 25 and 26 | 0.79 | 0 |
| BC035335 | 1898-1899 | LOC255189 | 0.000 between pos. 23 and 24 | 0.78 | 0 |
| BC080193 | 1900 | ERBB2 | 0.000 between pos. −1 and 0 | 0.74 | 2 |
| NM_199427 | 1901-1902 | ZFP64 | 0.000 between pos. −1 and 0 | 0.68 | 0 |
| BC042370 | 1903 | SUHW2 | 0.000 between pos. −1 and 0 | 0.67 | 0 |
| AL137506 | 1904-1905 | ELOVL7 | 0.000 between pos. −1 and 0 | 0.67 | 7 |
| AI888175 | 1906 | TRAF4 | 0.000 between pos. −1 and 0 | 0.63 | 0 |
| AI669751 | 1907 | SLC39A2 | 0.297 between pos. 23 and 24 | 0.62 | 8 |
| AI088739 | 1908 | HNF4G | 0.001 between pos. 21 and 22 | 0.59 | 0 |
| BC070300 | 1909 | SLC22A3 | 0.048 between pos. 33 and 34 | 0.58 | 12 |
| BC005827 | 1910 | HIST2H2BE | 0.000 between pos. −1 and 0 | 0.58 | 0 |
| BC041345 | 1911-1912 | AMD1 | 0.000 between pos. −1 and 0 | 0.58 | 0 |

TABLE 5C-continued

PROSTATE ENRICHED GENES IDENTIFIED BY RATIO SCHEMA (RATIO > 2.5)*

| Genbank Accession No. | Genbank SEQ ID NOs: | name | SignalP3.0 prediction Max cleavage site probability | SecretomeP2.0 prediction Secreted potential (Odds) | TMHMM 2.0 prediction Pred trans-membrane domains |
|---|---|---|---|---|---|
| BX390036 | 1913 | TYMS | 0.000 between pos. −1 and 0 | 0.57 | 0 |
| AK022455 | 1914 | PHC3 | 0.000 between pos. −1 and 0 | 0.57 | 0 |
| AL832940 | 1915-1916 | SARG | 0.000 between pos. 21 and 22 | 0.56 | 0 |
| BC000965 | 1917-1918 | MTERF | 0.000 between pos. 14 and 15 | 0.56 | 0 |
| NM_007253 | 1919-1920 | CYP4F8 | 0.781 between pos. 36 and 37 | 0.56 | 1 |
| AK124401 | 1921 | PPAP2A | 0.226 between pos. 30 and 31 | 0.53 | 5 |
| BC011408 | 1922-1923 | KIAA0056 | 0.000 between pos. −1 and 0 | 0.52 | 0 |
| AA469293 | 1924 | MSMB | 0.928 between pos. 20 and 21 | 0.51 | 1 |
| AK056914 | 1925 | VEGF | 0.000 between pos. −1 and 0 | 0.485 | 0 |
| NM_004360 | 1926-1927 | CDH1 | 0.487 between pos. 22 and 23 | 0.36 | 1 |
| BC062761 | 1928-1929 | TARP | 0.000 between pos. 20 and 21 | 0.35 | 1 |
| NM_001007278 | 1930-1931 | RFP2 | 0.000 between pos. 24 and 25 | 0.32 | 1 |
| NM_018670 | 1932-1933 | MESP1 | 0.002 between pos. 20 and 21 | 0.31 | 0 |
| AA026974 | 1934 | TRPM4 | 0.000 between pos. −1 and 0 | 0.3 | 5 |
| AI468032 | 1935 | PAK1IP1 | 0.000 between pos. 25 and 26 | 0.27 | 0 |
| CF122297 | 1936 | HNRPA1 | 0.000 between pos. 32 and 33 | 0.22 | 0 |
| CB053869 | 1937 | ZNF207 | 0.000 between pos. −1 and 0 | 0.21 | 0 |
| NM_032387 | 1938-1939 | WNK4 | 0.000 between pos. −1 and 0 | 0.2 | 0 |
| BQ448015 | 1940 | APXL2 | 0.000 between pos. 41 and 42 | 0.19 | 0 |
| AI554477 | 1941 | MED28 | | #N/A | #N/A |
| AK095655 | 1942 | LOC285300 | | #N/A | #N/A |
| AW291753 | 1943 | 0 | | #N/A | #N/A |
| BM023121 | 1944 | 0 | | #N/A | #N/A |
| AY338953 | 1945 | 0 | | #N/A | #N/A |
| AY533562 | 1946 | 0 | | #N/A | #N/A |
| BC030554 | 1947 | 0 | | #N/A | #N/A |

*ratio of prostate expression in tpm to other organs greater than 2.5

TABLE 5D

PROSTATE ENRICHED GENES IDENTIFIED BY RATIO SCHEMA (RATIO > 2.5)*

| Genbank Accession No. | Genbank SEQ ID NOs: | name | NN-score | Odds | Prostate Expression (tmp) |
|---|---|---|---|---|---|
| BC000637 | 1797-1798 | DHRS7 | 0.92 | 6.302 | 754 |
| BC029497 | 1799-1800 | NPY | 0.911 | 6.099 | 642 |
| AW172826 | 1801 | FLJ20010 | 0.911 | 6.061 | 92 |
| BI771919 | 1802 | C9orf61 | 0.906 | 5.902 | 91 |
| BU853306 | 1803 | Lrp2bp | 0.895 | 5.626 | 95 |
| BC007092 | 1804-1805 | HOXB13 | 0.875 | 5.145 | 344 |
| BC038962 | 1806-1807 | CREB3L4 | 0.866 | 4.721 | 334 |
| BC005029 | 1808-1809 | LEPREL1 | 0.857 | 4.594 | 118 |
| CB051271 | 1810 | KLK4 | 0.856 | 4.575 | 360 |
| NM_145013 | 1811-1812 | MGC35558 | 0.86 | 4.477 | 53 |
| BU157155 | 1813 | HAX1 | 0.854 | 4.412 | 67 |
| AW207206 | 1814 | 0 | 0.854 | 4.391 | 279 |
| BC013389 | 1815 | 0 | 0.85 | 4.304 | 64 |
| BC028162 | 1816-1817 | TMEM16G | 0.843 | 4.293 | 281 |

TABLE 5D-continued

PROSTATE ENRICHED GENES IDENTIFIED BY RATIO SCHEMA (RATIO > 2.5)*

| Genbank Accession No. | Genbank SEQ ID NOs: | name | NN-score | Odds | Prostate Expression (tmp) |
|---|---|---|---|---|---|
| BX099160 | 1818 | MGC31963 | 0.846 | 4.222 | 53 |
| BC005307 | 1819-1820 | KLK3 | 0.838 | 3.938 | 24771 |
| NM_005656 | 1821-1822 | TMPRSS2 | 0.816 | 3.861 | 1425 |
| BC026923 | 1823 | LOC221442 | 0.8 | 3.812 | 104 |
| BU159800 | 1824 | ARL10C | 0.822 | 3.76 | 167 |
| NM_032323 | 1825-1826 | MGC13102 | 0.788 | 3.699 | 238 |
| AI954252 | 1827 | 0 | 0.814 | 3.589 | 159 |
| BQ941313 | 1828 | SEPX1 | 0.798 | 3.492 | 56 |
| BC007460 | 1829-1830 | ACPP | 0.815 | 3.495 | 55 |
| BI911790 | 1831 | BIN3 | 0.806 | 3.41 | 54 |
| BC002707 | 1832-1833 | SPON2 | 0.766 | 3.063 | 873 |
| AK026938 | 1834 | 0 | 0.769 | 3.025 | 304 |
| BG818587 | 1835 | RPL18A | 0.768 | 2.806 | 58 |
| NM_005845 | 1836-1837 | ABCC4 | 0.747 | 2.671 | 454 |
| AA888242 | 1838 | RPS11 | 0.754 | 2.645 | 50 |
| CN353139 | 1839 | NSEP1 | 0.733 | 2.358 | 179 |
| CA256381 | 1840 | FLJ22955 | 0.688 | 2.196 | 57 |
| AA513505 | 1841 | HOXD11 | 0.715 | 2.142 | 99 |
| BG564253 | 1842 | ORM1 | 0.691 | 2.034 | 180 |
| AI572087 | 1843 | HTPAP | 0.677 | 2.013 | 332 |
| AA259243 | 1844 | KLK2 | 0.676 | 1.816 | 7988 |
| AI675682 | 1845 | SLC2A12 | 0.499 | 1.792 | 127 |
| NM_006096 | 1846-1847 | NDRG1 | 0.667 | 1.765 | 2688 |
| NM_000906 | 1848-1849 | NPR1 | 0.658 | 1.755 | 150 |
| NM_025087 | 1850-1851 | FLJ21511 | 0.605 | 1.756 | 230 |
| NM_004496 | 1852-1853 | FOXA1 | 0.627 | 1.711 | 793 |
| AI535878 | 1854 | ENPP3 | 0.635 | 1.693 | 54 |
| NM_032638 | 1855-1856 | GATA2 | 0.598 | 1.659 | 238 |
| BX331427 | 1857 | ARG2 | 0.621 | 1.56 | 150 |
| AI569484 | 1858 | XPO1 | 0.604 | 1.54 | 68 |
| BC009569 | 1859-1860 | ASB3 | 0.607 | 1.538 | 2781 |
| AK000028 | 1861 | 0 | 0.595 | 1.466 | 55 |
| BX100634 | 1862 | KLF3 | 0.581 | 1.401 | 136 |
| BC007003 | 1863-1864 | TGM4 | 0.59 | 1.368 | 5602 |
| NM_001008401 | 1865-1866 | FLJ16231 | 0.55 | 1.21 | 254 |
| BX113323 | 1867 | BLNK | 0.559 | 1.211 | 183 |
| NM_015865 | 1868-1869 | SLC14A1 | 0.335 | 1.208 | 255 |
| AI017286 | 1870 | PTPLB | 0.457 | 1.201 | 102 |
| NM_030774 | 1871-1872 | OR51E2 | 0.522 | 1.208 | 420 |
| NM_001441 | 1873-1874 | FAAH | 0.535 | 1.206 | 476 |
| AL044554 | 1875 | STAT6 | 0.547 | 1.174 | 71 |
| CB049466 | 1876 | ANKH | 0.335 | 1.153 | 58 |
| AW575747 | 1877 | DSCR1L2 | 0.471 | 1.123 | 225 |
| NM_024080 | 1878-1879 | TRPM8 | 0.519 | 1.077 | 267 |
| AV724505 | 1880 | TMC4 | 0.402 | 1.064 | 120 |
| BC005859 | 1881-1882 | ZNF589 | 0.491 | 0.992 | 156 |
| BC005408 | 1883-1884 | LRRK1 | 0.499 | 0.999 | 202 |
| AA177004 | 1885 | STEAP2 | 0.482 | 0.954 | 2156 |
| BC001216 | 1886 | SAFB2 | 0.427 | 0.954 | 76 |
| BG707154 | 1887 | CPE | 0.464 | 0.933 | 148 |
| AA024878 | 1888 | GNB2L1 | 0.465 | 0.921 | 59 |
| BU688574 | 1889 | LOC92689 | 0.461 | 0.918 | 82 |
| BC042118 | 1890 | DLG1 | 0.457 | 0.872 | 50 |
| NM_003007 | 1891-1892 | SEMG1 | 0.447 | 0.853 | 4660 |
| BM875598 | 1893 | SPATA13 | 0.422 | 0.812 | 79 |
| NM_177965 | 1894-1895 | LOC157657 | 0.434 | 0.819 | 92 |
| CA433208 | 1896 | KIAA1411 | 0.427 | 0.809 | 69 |
| BM984931 | 1897 | MGC20781 | 0.417 | 0.795 | 117 |
| BC035335 | 1898-1899 | LOC255189 | 0.49 | 1.04 | 56 |
| BC080193 | 1900 | ERBB2 | 0.377 | 0.743 | 1770 |
| NM_199427 | 1901-1902 | ZFP64 | 0.374 | 0.688 | 80 |
| BC042370 | 1903 | SUHW2 | 0.364 | 0.678 | 587 |
| AL137506 | 1904-1905 | ELOVL7 | 0.322 | 0.673 | 256 |
| AI888175 | 1906 | TRAF4 | 0.343 | 0.631 | 50 |
| AI669751 | 1907 | SLC39A2 | 0.34 | 0.629 | 60 |
| AI088739 | 1908 | HNF4G | 0.32 | 0.593 | 225 |
| BC070300 | 1909 | SLC22A3 | 0.294 | 0.581 | 77 |
| BC005827 | 1910 | HIST2H2BE | 0.306 | 0.587 | 912 |
| BC041345 | 1911-1912 | AMD1 | 0.317 | 0.588 | 438 |
| BX390036 | 1913 | TYMS | 0.306 | 0.571 | 67 |
| AK022455 | 1914 | PHC3 | 0.287 | 0.57 | 105 |
| AL832940 | 1915-1916 | SARG | 0.302 | 0.563 | 158 |
| BC000965 | 1917-1918 | MTERF | 0.3 | 0.56 | 190 |
| NM_007253 | 1919-1920 | CYP4F8 | 0.28 | 0.566 | 54 |

TABLE 5D-continued

PROSTATE ENRICHED GENES IDENTIFIED BY RATIO SCHEMA (RATIO > 2.5)*

| Genbank Accession No. | Genbank SEQ ID NOs: | name | NN-score | Odds | Prostate Expression (tmp) |
|---|---|---|---|---|---|
| AK124401 | 1921 | PPAP2A | 0.211 | 0.533 | 75 |
| BC011408 | 1922-1923 | KIAA0056 | 0.281 | 0.527 | 287 |
| AA469293 | 1924 | MSMB | 0.27 | 0.517 | 275 |
| AK056914 | 1925 | VEGF | 0.256 | 0.485 | 202 |
| NM_004360 | 1926-1927 | CDH1 | 0.179 | 0.362 | 192 |
| BC062761 | 1928-1929 | TARP | 0.174 | 0.353 | 564 |
| NM_001007278 | 1930-1931 | RFP2 | 0.162 | 0.322 | 192 |
| NM_018670 | 1932-1933 | MESP1 | 0.154 | 0.315 | 133 |
| AA026974 | 1934 | TRPM4 | 0.147 | 0.305 | 290 |
| AI468032 | 1935 | PAK1IP1 | 0.13 | 0.271 | 74 |
| CF122297 | 1936 | HNRPA1 | 0.106 | 0.228 | 104 |
| CB053869 | 1937 | ZNF207 | 0.099 | 0.212 | 72 |
| NM_032387 | 1938-1939 | WNK4 | 0.089 | 0.201 | 100 |
| BQ448015 | 1940 | APXL2 | 0.083 | 0.19 | 244 |
| AI554477 | 1941 | MED28 | | | 700 |
| AK095655 | 1942 | LOC285300 | | | 84 |
| AW291753 | 1943 | 0 | | | 310 |
| BM023121 | 1944 | 0 | | | 178 |
| AY338953 | 1945 | 0 | | | 166 |
| AY533562 | 1946 | 0 | | | 67 |
| BC030554 | 1947 | 0 | | | 66 |

*ratio of prostate expression in tpm to other organs greater than 2.5

Additional analysis was carried out to determine the secretion potential of the prostate-specific genes identified. The analysis programs used included SignalP 3.0, Secretome 2.0 and TMHMM 2.0 (see http colon double slash www dot cbs dot dtu dot dk/services/). The SignalP analysis identifies classical secreted proteins and was conducted using the classical secretion pathway prediction as described at http colon double slash www dot cbs dot dtu dot dk/services/SignalP/ (see Jannick Dyrløv Bendtsen, et al. J. Mol. Biol., 340:783-795, 2004; Henrik Nielsen et al., Protein Engineering, 10:1-6, 1997; Henrik Nielsen and Anders Krogh. Proceedings of the Sixth International Conference on Intelligent Systems for Molecular Biology (ISMB 6), AAAI Press, Menlo Park, Calif., pp. 122-130, 1998). The Secretome2.0 analysis identifies nonclassical secreted proteins (see J. Dyrløv Bendtsen, et al., Protein Eng. Des. Sel., 17(4):349-356, 2004). TMHMM uses hidden Markov model for three-state (TM-helix, inside, outside) topology prediction of transmembrane proteins (see Erik L. L. Sonnhammer, et al., Proc. of Sixth Int. Conf. on Intelligent Systems for Molecular Biology, p. 175-182 Ed. J. Glasgow, T. Littlejohn, F. Major, R. Lathrop, D. Sankoff, and C. Sensen, Menlo Park, Calif.: AAAI Press, 1998). According to the SignalP analysis method, proteins with an odds scoring 3 or higher have a high confidence of being secreted. However, it should be noted that several proteins scoring well below 3 by this method are known to be secreted proteins detected in the blood (see e.g., Table 5, KLK2). Further, these analyses do not take into account proteins that may be shed.

In summary, this example identifies prostate-specific and potentially secreted prostate-specific proteins that can be used in diagnostic panels for the detection of diseases of the prostate.

Example 8

Prostate Cancer Diagnostics Using Multiparameter Analysis

This example describes a multiparameter diagnostic fingerprint using the NDRG1 prostate-specific protein in combination with PSA. The NDRG1 prostate-specific protein further improved prostate cancer detection when used in combination with PSA.

Commercially available antibodies specific for numerous proteins encoded by prostate-specific genes as described in Table 5 were used to determine which proteins would be useful in a multiparameter diagnostic assay for prostate cancer. Most of the commercially available antibodies were not suitable (e.g., were not sensitive enough or showed non-specific binding). However, the antibody available for NDRG1 (anti-NDRG1 (C terminal) poly IgY; Cat#A22272B; GenWay Inc) was shown to specifically bind to NDRG1 from serum. NDRG1 is a member of the N-myc downregulated gene (NDRG) family that belongs to the alpha/beta hydrolase superfamily. It is classified as a tumor suppressor and heavy metal-response protein. Its expression is modulated by diverse physiological and pathological conditions including hypoxia, cellular differentiation, heavy metal, N-myc and neoplasia (Lachat P, et al.; Histochem Cell Biol. 2002 November; 118 (5):399-408).

NDRG1 protein expression was analyzed in serum samples from 18 advanced prostate cancer patients, 21 prostate cancer patients with localized cancer, and 22 normal controls. Western blot analysis was used to measure serum protein expression as follows: Serum was diluted (1:10) with lysis buffer (50 mM Hepes, pH 7.4, 4 mM EDTA, 2 mM EGTA, 2 μM PMSF, 20 μg/ml, leupeptine (or 1× protease inhibitor cocktail), 1 mM $Na_3VO_4$, 10 mM NaF, 2 mM Na pyrophosphate, 1% Triton X-100). Protein concentration was determined using the Bio-Rad protein assay kit. Serum proteins (50 μg) were subjected to SDS-PAGE electrophoresis and transferred to a PVDF membrane (Hybond-P, Amersham Pharmacia Biotech, Piscataway, N.J.). The membrane was blocked with 4% non-fat milk in TBS (25 mM Tris, pH 7.4, 125 mM NaCl) for 1 h at room temperature, followed by incubation with primary antibodies against NDRG1 IgY (1:500) overnight at 4° C. The membranes were washed 3 times with TBS, and then incubated with horseradish peroxidase conjugated anti-rabbit IgY (1:16,000) for 1 h. The immunoblot was then washed five times with TBS and developed using an ECL (Amersham). The intensities of the single band corresponding to the NDRG1 protein were then scored. The results are summarized in Table 6 together with serum PSA measurements performed using a commercial ELISA kit.

TABLE 6

COMBINED ANALYSIS OF NDRG1 AND PSA SERUM EXPRESSION INCREASES PROSTATE CANCER DIAGNOSIS CONFIDENCE.

| cancer status | NDRG-1 intensity (scores*) | PSA values (ng/ml) | serum diagnosis by PSA | serum diagnosis by NDRG1 |
|---|---|---|---|---|
| Advanced | 3 | 70.48 | identified as cancer by PSA assay | identified as cancer by NDRG1 assay |
| Advanced | 4 | 127.3 | identified as cancer by PSA assay | identified as cancer by NDRG1 assay |
| Advanced | 4 | 422.1 | identified as cancer by PSA assay | identified as cancer by NDRG1 assay |
| Advanced | 4 | 1223 | identified as cancer by PSA assay | identified as cancer by NDRG1 assay |
| Advanced | 4 | 71.28 | identified as cancer by PSA assay | identified as cancer by NDRG1 assay |
| Advanced | 2 | 133.2 | identified as cancer by PSA assay | missed byNDRG1 assay |
| Advanced | 4 | 353.7 | identified as cancer by PSA assay | identified as cancer by NDRG1 assay |
| Advanced | 1 | 73.95 | identified as cancer by PSA assay | missed byNDRG1 assay |
| Advanced | 3 | 454.8 | identified as cancer by PSA assay | identified as cancer by NDRG1 assay |
| Advanced | 4 | 474 | identified as cancer by PSA assay | identified as cancer by NDRG1 assay |
| Advanced | 6 | 150.1 | identified as cancer by PSA assay | identified as cancer by NDRG1 assay |
| Advanced | 0 | 1375 | identified as cancer by PSA assay | missed byNDRG1 assay |
| Advanced | 6 | 71.28 | identified as cancer by PSA assay | identified as cancer by NDRG1 assay |
| Advanced | 6 | 4066 | identified as cancer by PSA assay | identified as cancer by NDRG1 assay |
| Advanced | 4 | 1199 | identified as cancer by PSA assay | identified as cancer by NDRG1 assay |
| Advanced | 1 | 38.14 | identified as cancer by PSA assay | missed byNDRG1 assay |
| Advanced | 6 | 552.6 | identified as cancer by PSA assay | identified as cancer by NDRG1 assay |
| Advanced | 5 | 321 | identified as cancer by PSA assay | identified as cancer by NDRG1 assay |
| Primary | −1 | 14.2 | possibly cancer | |
| Primary | 2 | 6.27 | Grey Zone of diagnosis by Psa | |
| Primary | 2 | 9.2 | Grey Zone of diagnosis by Psa | |
| Primary | 1 | 8.57 | Grey Zone of diagnosis by Psa | |
| Primary | 0 | 5.67 | Grey Zone of diagnosis by Psa | |
| Primary | 2 | 11.3 | possibly cancer | |
| Primary | 0 | 4.58 | Grey Zone of diagnosis by Psa | |
| Primary | 0 | 5.67 | Grey Zone of diagnosis by Psa | |
| Primary | −1 | 6.48 | Grey Zone of diagnosis by Psa | |
| Primary | 3 | 12.71 | possibly cancer | strong NDRG-1 expression reinforces the diagnosis of this patient as cancer |
| Primary | 3 | 4.93 | Grey Zone of diagnosis by Psa | strong NDRG-1 expression reinforces the diagnosis of this patient as cancer |
| Primary | 1 | 3.16 | Grey Zone of diagnosis by Psa | |
| Primary | 1 | 4.87 | Grey Zone of diagnosis by Psa | |
| Primary | 1 | 4.66 | Grey Zone of diagnosis by Psa | |
| Primary | 1 | 6.87 | Grey Zone of diagnosis by Psa | |
| Primary | 0 | 3.91 | Grey Zone of diagnosis by Psa | |
| Primary | 0 | 6.48 | Grey Zone of diagnosis by Psa | |
| Primary | 2 | 13.1 | possibly cancer | |
| Primary | 0 | 4.58 | Grey Zone of diagnosis by Psa | |
| Primary | 1 | 4.72 | Grey Zone of diagnosis by Psa | |
| Primary | 4 | 12.71 | possibly cancer | strong NDRG-1 expression reinforces the diagnosis of this patient as cancer |
| Normal | −1 | 0.8 | Normal | normal |
| Normal | −1 | 0.8 | Normal | normal |
| Normal | 0 | 0.6 | Normal | normal |
| Normal | 1 | 1 | Normal | normal |
| Normal | −1 | 1.2 | Normal | normal |
| Normal | −1 | 1.91 | Normal | normal |
| Normal | 2 | 0.6 | Normal | normal |
| Normal | −1 | 0.3 | Normal | normal |
| Normal | 0 | 1 | Normal | normal |
| Normal | −1 | 0.4 | Normal | normal |
| Normal | −1 | 0.8 | Normal | normal |
| Normal | 0 | 1 | Normal | normal |
| Normal | 1 | 0.8 | Normal | normal |
| Normal | 2 | 0.6 | Normal | normal |
| Normal | 1 | 0.5 | Normal | normal |
| Normal | 1 | 1 | Normal | normal |
| Normal | −1 | 0.7 | Normal | normal |
| Normal | −1 | 1.2 | Normal | normal |
| Normal | −1 | 1.1 | Normal | normal |
| Normal | 0 | 0.8 | Normal | normal |
| Normal | 0 | 0.7 | Normal | normal |
| Normal | 0 | 0.6 | Normal | normal |

*scores: no expression, −1; no expression to very faint, 0; expression levels then scored from1 to 6 by intensities PSA was detected in 100% of the advanced prostate cancers. NDRG1 was detected in 14 out of 18 advanced cancers (78%) (see Table 6, scores greater than 3). Serum PSA levels below 15 ng/ml, particularly, levels between 4-10 ng/ml (often referred to as the 'grey zone' in the PSA assay) cannot reliably detect prostate cancer as PSA levels in this range may be the result of other factors such as infection (prostatitis) or benign prostatic hyperplasia (BPH), a common condition in older men. Additionally, the normal range of PSA values increases with patient age. NDRG1 detection in serum reinforced the diagnosis of three prostate cancer patients with PSA levels between 4.9 ng/ml and 15 ng/ml. In these three patients, the NDRG1 scores were 3 or 4, significantly higher than the NDRG1 scores in a cohort of 22 normal individuals (average 0.09, range −1 to 2).

Thus, this example illustrates that the use of two or more prostate specific/enriched cancer markers such as NDRG1 and PSA can improve prostate cancer diagnosis to reduce false positive and false negative rates.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (1947 sequences)

SEQ ID NO: 1 - DNA, 4534 bp, Homo sapiens
ggcccggcccctcgaggcaccgcctttcaattagcactcgctgattggtcgctgctcgcgcggtctcctgggtgacgggaacgcggtagcctgcttggtggagaccgggtgcgcctgcgtacttcatagttcgcgtagcggctcgagcgtggagatgaagcgtattttctcactgctagaaaagacttggcttggcgcaccaatacagtttgcctggaaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttgaaaaactttaaaataaaattgttgactagaaaaaaaaaaaaaaa

SEQ ID NO: 2 - protein, 1342 aa, Homo sapiens
MKRIFSLLEKTWLGAPIQFAWKKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLLIYNHQTSRKIPVLGKHTKRITCGCWNAENLLALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 3 - DNA, 17 bp, Homo sapiens
gatcaaatgtgtggcct

SEQ ID NO: 4 - DNA, 17 bp, Homo sapiens
gatcataatgttaacta

SEQ ID NO: 5 - DNA, 17 bp, Homo sapiens
gatcatccagaggagct

SEQ ID NO: 6 - DNA, 17 bp, Homo sapiens
gatcgcggtattaaatc

SEQ ID NO: 7 - DNA, 17 bp, Homo sapiens
gatctcctgtccatcag

SEQ ID NO: 8 - DNA, 17 bp, Homo sapiens
gatccccttcaaggaca

SEQ ID NO: 9 - DNA, 17 bp, Homo sapiens
gatcattgccatcacca

SEQ ID NO: 10 - DNA, 17 bp, Homo sapiens
gatctgaaaattcttgg

SEQ ID NO: 11 - DNA, 17 bp, Homo sapiens
gatccaccttggcctcc

SEQ ID NO: 12 - DNA, 17 bp, Homo sapiens
gatcatgaatgactgac

SEQ ID NO: 13 - DNA, 17 bp, Homo sapiens
gatcaagtcctttgtga

SEQ ID NO: 14 - DNA, 17 bp, Homo sapiens
gatcaccaaaacctgat

SEQ ID NO: 15 - DNA, 17 bp, Homo sapiens
gatcaatctgaactatc

SEQ ID NO: 16 - DNA, 17 bp, Homo sapiens
gatccctctgtacaggc

SEQ ID NO: 17 - DNA, 17 bp, Homo sapiens
gatctggttgaaaattg

SEQ ID NO: 18 - DNA, 17 bp, Homo sapiens
gatctcccatgttggct

SEQ ID NO: 19 - DNA, 17 bp, Homo sapiens
gatcagaaaatccctct

SEQ ID NO: 20 - DNA, 17 bp, Homo sapiens
gatcaaggatgaaagct

SEQ ID NO: 21 - DNA, 17 bp, Homo sapiens
gatctgattatttactt

SEQ ID NO: 22 - DNA, 17 bp, Homo sapiens
gatcaagtcctttgtga

SEQ ID NO: 23 - DNA, 17 bp, Homo sapiens
gatcctgtcaaaatagt

SEQ ID NO: 24 - DNA, 17 bp, Homo sapiens
gatcattatatcattgg

SEQ ID NO: 25 - DNA, 17 bp, Homo sapiens
gatcatcagtcaccgaa

SEQ ID NO: 26 - DNA, 17 bp, Homo sapiens
gatcgggggcgtagcat

SEQ ID NO: 27 - DNA, 17 bp, Homo sapiens
gatctactctgtatggg

SEQ ID NO: 28 - DNA, 17 bp, Homo sapiens
gatcagcactctaccac

SEQ ID NO: 29 - DNA, 17 bp, Homo sapiens
gatctggtgtagtatat

SEQ ID NO: 30 - DNA, 17 bp, Homo sapiens
gatcagtacacaatgaa

SEQ ID NO: 31 - DNA, 17 bp, Homo sapiens
gatctcagttctgcgtt

SEQ ID NO: 32 - DNA, 17 bp, Homo sapiens
gatcctgagctcccttt

SEQ ID NO: 33 - DNA, 17 bp, Homo sapiens
gatcatgcagtgacata

SEQ ID NO: 34 - DNA, 17 bp, Homo sapiens
gatctgtatgtgattgg

SEQ ID NO: 35 - DNA, 17 bp, Homo sapiens
gatccacactgagagag

SEQ ID NO: 36 - DNA, 17 bp, Homo sapiens
gatccagaaataaagtc

SEQ ID NO: 37 - DNA, 17 bp, Homo sapiens
gatcctcctatgttgtt

SEQ ID NO: 38 - DNA, 17 bp, Homo sapiens
gatcagagaagatgata

SEQ ID NO: 39 - DNA, 17 bp, Homo sapiens
gatccctaggtcttggg

SEQ ID NO: 40 - DNA, 17 bp, Homo sapiens
gatccacatcctctaca

SEQ ID NO: 41 - DNA, 17 bp, Homo sapiens
gatcaataataatgagg

SEQ ID NO: 42 - DNA, 17 bp, Homo sapiens
gatccttcagccttcag

SEQ ID NO: 43 - DNA, 17 bp, Homo sapiens
gatctggaacctcagcc

SEQ ID NO: 44 - DNA, 17 bp, Homo sapiens
gatcagagatgcaccac

SEQ ID NO: 45 - DNA, 17 bp, Homo sapiens
gatcaaaggtttaaagt

SEQ ID NO: 46 - DNA, 17 bp, Homo sapiens
gatcagctgtttgtcat

SEQ ID NO: 47 - DNA, 17 bp, Homo sapiens
gatcggtgcgttctcct

SEQ ID NO: 48 - DNA, 17 bp, Homo sapiens
gatctacaaaggccatg

SEQ ID NO: 49 - DNA, 17 bp, Homo sapiens
gatcatttattttaagc

SEQ ID NO: 50 - DNA, 17 bp, Homo sapiens
gatcagtctttattaat

SEQ ID NO: 51 - DNA, 17 bp, Homo sapiens
gatcttggctgtattta

SEQ ID NO: 52 - DNA, 17 bp, Homo sapiens
gatcttgtgctgtgcta

SEQ ID NO: 53 - DNA, 17 bp, Homo sapiens
gatcaaataacaagtct

SEQ ID NO: 54 - DNA, 17 bp, Homo sapiens
gatctctatgtttactt

SEQ ID NO: 55 - DNA, 17 bp, Homo sapiens
gatcctgacacataaga

SEQ ID NO: 56 - DNA, 17 bp, Homo sapiens
gatcattttgtattaat

SEQ ID NO: 57 - DNA, 17 bp, Homo sapiens
gatcgtctcatatttgc

SEQ ID NO: 58 - DNA, 17 bp, Homo sapiens
gatccccctcttcaatg

SEQ ID NO: 59 - DNA, 17 bp, Homo sapiens
gatcaaatgctattgca

SEQ ID NO: 60 - DNA, 17 bp, Homo sapiens
gatctgtgacagcagca

SEQ ID NO: 61 - DNA, 17 bp, Homo sapiens
gatcaaatctgtacagt

SEQ ID NO: 62 - DNA, 17 bp, Homo sapiens
gatcctgtgcaacaaga

SEQ ID NO: 63 - DNA, 17 bp, Homo sapiens
gatctgtggtggcaatg

SEQ ID NO: 64 - DNA, 17 bp, Homo sapiens
gatcagaatcatggtct

SEQ ID NO: 65 - DNA, 17 bp, Homo sapiens
gatctctttgactgctg

SEQ ID NO: 66 - DNA, 17 bp, Homo sapiens
gatccaaaaacatcctg

SEQ ID NO: 67 - DNA, 17 bp, Homo sapiens
gatcagaagactttaat

SEQ ID NO: 68 - DNA, 17 bp, Homo sapiens
gatcaggacacttagca

SEQ ID NO: 69 - DNA, 17 bp, Homo sapiens
gatcatcacagtttgag

SEQ ID NO: 70 - DNA, 17 bp, Homo sapiens
gatcccagagagcagct

SEQ ID NO: 71 - DNA, 17 bp, Homo sapiens
gatcggccatcaaggga

SEQ ID NO: 72 - DNA, 17 bp, Homo sapiens
gatctggaccagagaca

SEQ ID NO: 73 - DNA, 17 bp, Homo sapiens
gatcagcatgggccacg

SEQ ID NO: 74 - DNA, 17 bp, Homo sapiens
gatctactacttggcct

SEQ ID NO: 75 - DNA, 17 bp, Homo sapiens
gatcctgttgggaaaga

SEQ ID NO: 76 - DNA, 17 bp, Homo sapiens
gatcctgttgggaaaga

SEQ ID NO: 77 - DNA, 17 bp, Homo sapiens
gatccctgaagttgccc

SEQ ID NO: 78 - DNA, 17 bp, Homo sapiens
gatcttggctgtattta

SEQ ID NO: 79 - DNA, 17 bp, Homo sapiens
gatccctgaagttgccc

SEQ ID NO: 80 - DNA, 17 bp, Homo sapiens
gatcctgttgggaaaga

SEQ ID NO: 81 - DNA, 17 bp, Homo sapiens
gatcttggctgtattta

SEQ ID NO: 82 - DNA, 17 bp, Homo sapiens
gatccctgaagttgccc

SEQ ID NO: 83 - DNA, 17 bp, Homo sapiens
gatcttggctgtattta

SEQ ID NO: 84 - DNA, 17 bp, Homo sapiens
gatccctgaagttgccc

SEQ ID NO: 85 - DNA, 17 bp, Homo sapiens
gatcctgttgggaaaga

SEQ ID NO: 86 - DNA, 17 bp, Homo sapiens
gatcttggctgtattta

SEQ ID NO: 87 - DNA, 17 bp, Homo sapiens
gatctgtgctgacccca

SEQ ID NO: 88 - DNA, 17 bp, Homo sapiens
gatctcttggaatgaca

SEQ ID NO: 89 - DNA, 17 bp, Homo sapiens
gatcaccatcaagccag

SEQ ID NO: 90 - DNA, 17 bp, Homo sapiens
gatcaaacagctctagt

SEQ ID NO: 91 - DNA, 17 bp, Homo sapiens
gatcccctgttacgaca

SEQ ID NO: 92 - DNA, 17 bp, Homo sapiens
gatctctgattaccagc

SEQ ID NO: 93 - DNA, 17 bp, Homo sapiens
gatcattgaacgagaca

SEQ ID NO: 94 - DNA, 17 bp, Homo sapiens
gatcacagaccacgagt

SEQ ID NO: 95 - DNA, 17 bp, Homo sapiens
gatctgcatcagttgta

SEQ ID NO: 96 - DNA, 17 bp, Homo sapiens
gatctcttgctagattt

SEQ ID NO: 97 - DNA, 17 bp, Homo sapiens
gatcacaaggctgcctg

SEQ ID NO: 98 - DNA, 17 bp, Homo sapiens
gatcgtttctcatctct

SEQ ID NO: 99 - DNA, 17 bp, Homo sapiens
gatccccgcgatacttc

SEQ ID NO: 100 - DNA, 17 bp, Homo sapiens
gatctttttttggatat

SEQ ID NO: 101 - DNA, 17 bp, Homo sapiens
gatccgagagtaaggaa

SEQ ID NO: 102 - DNA, 17 bp, Homo sapiens
gatcatgtgtttccatg

SEQ ID NO: 103 - DNA, 17 bp, Homo sapiens
gatctcagaacaacctt

SEQ ID NO: 104 - DNA, 17 bp, Homo sapiens
gatcttacctcctgata

SEQ ID NO: 105 - DNA, 17 bp, Homo sapiens
gatcccagactggttct

SEQ ID NO: 106 - DNA, 17 bp, Homo sapiens
gatcaagtgcatttgac

SEQ ID NO: 107 - DNA, 17 bp, Homo sapiens
gatcagtgcgtcatgga

SEQ ID NO: 108 - DNA, 17 bp, Homo sapiens
gatccaagaggaagaat

SEQ ID NO: 109 - DNA, 17 bp, Homo sapiens
gatccagcaaacaggtt

SEQ ID NO: 110 - DNA, 17 bp, Homo sapiens
gatcatagaaggctatt

SEQ ID NO: 111 - DNA, 17 bp, Homo sapiens
gatcccccttcatttga

SEQ ID NO: 112 - DNA, 17 bp, Homo sapiens
gatcccaaatttgaagt

SEQ ID NO: 113 - DNA, 17 bp, Homo sapiens
gatctgctttctgtaat

SEQ ID NO: 114 - DNA, 17 bp, Homo sapiens
gatcactccttatttgc

SEQ ID NO: 115 - DNA, 17 bp, Homo sapiens
gatcaccttcgacgact

SEQ ID NO: 116 - DNA, 17 bp, Homo sapiens
gatctctattgtaatct

SEQ ID NO: 117 - DNA, 17 bp, Homo sapiens
gatctcctggctgcaaa

SEQ ID NO: 118 - DNA, 17 bp, Homo sapiens
gatcccagtctctgcca

SEQ ID NO: 119 - DNA, 17 bp, Homo sapiens
gatcttctttataattc

SEQ ID NO: 120 - DNA, 17 bp, Homo sapiens
gatctgttcaaacagca

SEQ ID NO: 121 - DNA, 17 bp, Homo sapiens
gatcgtgctcacaggca

SEQ ID NO: 122 - DNA, 17 bp, Homo sapiens
gatcaatatgtaaatat

SEQ ID NO: 123 - DNA, 17 bp, Homo sapiens
gatcagctttgctcctg

SEQ ID NO: 124 - DNA, 17 bp, Homo sapiens
gatctctatggctgtaa

SEQ ID NO: 125 - DNA, 17 bp, Homo sapiens
gatctcagaacctctgt

SEQ ID NO: 126 - DNA, 17 bp, Homo sapiens
gatccagccattactaa

SEQ ID NO: 127 - DNA, 17 bp, Homo sapiens
gatctttcccaagattg

SEQ ID NO: 128 - DNA, 17 bp, Homo sapiens
gatcgattctgtgacac

SEQ ID NO: 129 - DNA, 17 bp, Homo sapiens
gatctattttttctaaa

SEQ ID NO: 130 - DNA, 17 bp, Homo sapiens
gatcaagaatcctgctc

SEQ ID NO: 131 - DNA, 17 bp, Homo sapiens
gatcggtggagaacctc

SEQ ID NO: 132 - DNA, 17 bp, Homo sapiens
gatcggtggagaacctc

SEQ ID NO: 133 - DNA, 17 bp, Homo sapiens
gatcggtggagaacctc

SEQ ID NO: 134 - DNA, 17 bp, Homo sapiens
gatcatgggtgaggggt

SEQ ID NO: 135 - DNA, 17 bp, Homo sapiens
gatccccctcaccatga

SEQ ID NO: 136 - DNA, 17 bp, Homo sapiens
gatcaactaatagctct

SEQ ID NO: 137 - DNA, 17 bp, Homo sapiens
gatcaaataaagttata

SEQ ID NO: 138 - DNA, 17 bp, Homo sapiens
gatcaaggagacccgga

SEQ ID NO: 139 - DNA, 17 bp, Homo sapiens
gatcaaggagacccgga

SEQ ID NO: 140 - DNA, 17 bp, Homo sapiens
gatcctaagccatagac

SEQ ID NO: 141 - DNA, 17 bp, Homo sapiens
gatccattgagcccagc

SEQ ID NO: 142 - DNA, 17 bp, Homo sapiens
gatctgagggcgtcttc

SEQ ID NO: 143 - DNA, 17 bp, Homo sapiens
gatctcggtagttacgt

SEQ ID NO: 144 - DNA, 17 bp, Homo sapiens
gatcccaagatgattaa

SEQ ID NO: 145 - DNA, 17 bp, Homo sapiens
gatctcaaacttgtctt

SEQ ID NO: 146 - DNA, 17 bp, Homo sapiens
gatcatagttattatac

SEQ ID NO: 147 - DNA, 17 bp, Homo sapiens
gatcccaactgctcctg

SEQ ID NO: 148 - DNA, 17 bp, Homo sapiens
gatcaaaatgctaaaac

SEQ ID NO: 149 - DNA, 17 bp, Homo sapiens
gatctgtttgttccctg

SEQ ID NO: 150 - DNA, 17 bp, Homo sapiens
gatcaacagtggcaatg

SEQ ID NO: 151 - DNA, 17 bp, Homo sapiens
gatcaataataatgagg

SEQ ID NO: 152 - DNA, 17 bp, Homo sapiens
gatcaactaatagctct

SEQ ID NO: 153 - DNA, 17 bp, Homo sapiens
gatcaaataaagttata

SEQ ID NO: 154 - DNA, 17 bp, Homo sapiens
gatcaaataaagttata

SEQ ID NO: 155 - DNA, 17 bp, Homo sapiens
gatcaaataaagttata

SEQ ID NO: 156 - DNA, 17 bp, Homo sapiens
gatcaactaatagctct

SEQ ID NO: 157 - DNA, 17 bp, Homo sapiens
gatcaactaatagctct

SEQ ID NO: 158 - DNA, 17 bp, Homo sapiens
gatcaaataaagttata

SEQ ID NO: 159 - DNA, 17 bp, Homo sapiens
gatcaactaatagctct

SEQ ID NO: 160 - DNA, 17 bp, Homo sapiens
gatcaactaatagctct

SEQ ID NO: 161 - DNA, 17 bp, Homo sapiens
gatcaaataaagttata

SEQ ID NO: 162 - DNA, 17 bp, Homo sapiens
gatcaactaatagctct

SEQ ID NO: 163 - DNA, 17 bp, Homo sapiens
gatcaaataaagttata

SEQ ID NO: 164 - DNA, 17 bp, Homo sapiens
gatcaaataaagttata

SEQ ID NO: 165 - DNA, 17 bp, Homo sapiens
gatcaactaatagctct

SEQ ID NO: 166 - DNA, 17 bp, Homo sapiens
gatctgattttttcccc

SEQ ID NO: 167 - DNA, 17 bp, Homo sapiens
gatcagaaatgactgtg

SEQ ID NO: 168 - DNA, 17 bp, Homo sapiens
gatcactgagaaaaaat

SEQ ID NO: 169 - DNA, 17 bp, Homo sapiens
gatccaagagtttagtg

SEQ ID NO: 170 - DNA, 17 bp, Homo sapiens
gatctttgctggcaagc

SEQ ID NO: 171 - DNA, 17 bp, Homo sapiens
gatccacactgagagag

SEQ ID NO: 172 - DNA, 17 bp, Homo sapiens
gatctgtattattaaat

SEQ ID NO: 173 - DNA, 17 bp, Homo sapiens
gatctgtttgttccctg

SEQ ID NO: 174 - DNA, 17 bp, Homo sapiens
gatcccctgcctggtgc

SEQ ID NO: 175 - DNA, 17 bp, Homo sapiens
gatcaactaatagctct

SEQ ID NO: 176 - DNA, 17 bp, Homo sapiens
gatcaaataaagttata

SEQ ID NO: 177 - DNA, 17 bp, Homo sapiens
gatctttttcaagtctt

SEQ ID NO: 178 - DNA, 17 bp, Homo sapiens
gatcatgtatgagatag

SEQ ID NO: 179 - DNA, 17 bp, Homo sapiens
gatccttcaggcagtaa

SEQ ID NO: 180 - DNA, 17 bp, Homo sapiens
gatctttttttggatat

SEQ ID NO: 181 - DNA, 17 bp, Homo sapiens
gatcccagtctctgcca

SEQ ID NO: 182 - DNA, 17 bp, Homo sapiens
gatcaagacgagcctgc

SEQ ID NO: 183 - DNA, 17 bp, Homo sapiens
gatcccagctgatgtag

SEQ ID NO: 184 - DNA, 17 bp, Homo sapiens
gatcatgaagacctgct

SEQ ID NO: 185 - DNA, 17 bp, Homo sapiens
gatctcaaggttgatag

SEQ ID NO: 186 - DNA, 17 bp, Homo sapiens
gatcaccaggctgccca

SEQ ID NO: 187 - DNA, 17 bp, Homo sapiens
gatcaaaatgctaaaac

SEQ ID NO: 188 - DNA, 17 bp, Homo sapiens
gatcaagatgacactga

SEQ ID NO: 189 - DNA, 17 bp, Homo sapiens
gatcgggaactcctgct

SEQ ID NO: 190 - DNA, 17 bp, Homo sapiens
gatcttgtctttaaaac

SEQ ID NO: 191 - DNA, 17 bp, Homo sapiens
gatccacacacgttggt

SEQ ID NO: 192 - DNA, 17 bp, Homo sapiens
gatcatcagtcaccgaa

SEQ ID NO: 193 - DNA, 17 bp, Homo sapiens
gatccagtattcagtca

SEQ ID NO: 194 - DNA, 17 bp, Homo sapiens
gatccttgcagggagct

SEQ ID NO: 195 - DNA, 17 bp, Homo sapiens
gatctccttgccccagc

SEQ ID NO: 196 - DNA, 17 bp, Homo sapiens
gatcgcctagtatgttc

SEQ ID NO: 197 - DNA, 17 bp, Homo sapiens
gatcagactgtattaaa

SEQ ID NO: 198 - DNA, 17 bp, Homo sapiens
gatcggccctactagat

SEQ ID NO: 199 - DNA, 17 bp, Homo sapiens
gatctcccactgcgggg

SEQ ID NO: 200 - DNA, 17 bp, Homo sapiens
gatctgtgatggtcagc

SEQ ID NO: 201 - DNA, 17 bp, Homo sapiens
gatcactgtggtatcta

SEQ ID NO: 202 - DNA, 17 bp, Homo sapiens
gatcatcagtcaccgaa

SEQ ID NO: 203 - DNA, 17 bp, Homo sapiens
gatcatttgtttattaa

SEQ ID NO: 204 - DNA, 17 bp, Homo sapiens
gatcaaatatgtaaaat

SEQ ID NO: 205 - DNA, 17 bp, Homo sapiens
gatctcttgctagattt

SEQ ID NO: 206 - DNA, 17 bp, Homo sapiens
gatcaccttcgacgact

SEQ ID NO: 207 - DNA, 17 bp, Homo sapiens
gatcggattgattaaaa

SEQ ID NO: 208 - DNA, 17 bp, Homo sapiens
gatctagttgggagata

SEQ ID NO: 209 - DNA, 17 bp, Homo sapiens
gatcttttttggctact

SEQ ID NO: 210 - DNA, 17 bp, Homo sapiens
gatcacattttctgttg

SEQ ID NO: 211 - DNA, 17 bp, Homo sapiens
gatcacctgggtttctt

SEQ ID NO: 212 - DNA, 17 bp, Homo sapiens
gatctattagattcaaa

SEQ ID NO: 213 - DNA, 17 bp, Homo sapiens
gatctcttattttacaa

SEQ ID NO: 214 - DNA, 17 bp, Homo sapiens
gatcatagaaggctatt

SEQ ID NO: 215 - DNA, 17 bp, Homo sapiens
gatcttcctggacagga

SEQ ID NO: 216 - DNA, 17 bp, Homo sapiens
gatcaaggaccggccca

SEQ ID NO: 217 - DNA, 17 bp, Homo sapiens
gatcgcatttttgtaaa

SEQ ID NO: 218 - DNA, 17 bp, Homo sapiens
gatccatcctcatctcc

SEQ ID NO: 219 - DNA, 17 bp, Homo sapiens
gatcgatggtggcgctt

SEQ ID NO: 220 - DNA, 17 bp, Homo sapiens
gatcttataaaaagaaa

SEQ ID NO: 221 - DNA, 17 bp, Homo sapiens
gatctgaacgatgccgt

SEQ ID NO: 222 - DNA, 17 bp, Homo sapiens
gatctccccgccgcagc

SEQ ID NO: 223 - DNA, 17 bp, Homo sapiens
gatcgtcgtccaggcca

SEQ ID NO: 224 - DNA, 17 bp, Homo sapiens
gatcgttggggaacccc

SEQ ID NO: 225 - DNA, 17 bp, Homo sapiens
gatcctatatgtcctgt

SEQ ID NO: 226 - DNA, 17 bp, Homo sapiens
gatcgatggttgacaat

SEQ ID NO: 227 - DNA, 17 bp, Homo sapiens
gatcttgtactaactta

SEQ ID NO: 228 - DNA, 17 bp, Homo sapiens
gatcccgatgttcttaa

SEQ ID NO: 229 - DNA, 17 bp, Homo sapiens
gatcctgtttaacaaag

SEQ ID NO: 230 - DNA, 17 bp, Homo sapiens
gatcacgcacacacaat

SEQ ID NO: 231 - DNA, 17 bp, Homo sapiens
gatccagccagacttgc

SEQ ID NO: 232 - DNA, 17 bp, Homo sapiens
gatccacactggagaga

SEQ ID NO: 233 - DNA, 17 bp, Homo sapiens
gatctcagttctgcgtt

SEQ ID NO: 234 - DNA, 17 bp, Homo sapiens
gatctacacctcttgcc

SEQ ID NO: 235 - DNA, 17 bp, Homo sapiens
gatccagctggaaagct

SEQ ID NO: 236 - DNA, 17 bp, Homo sapiens
gatccttcaggcagtaa

SEQ ID NO: 237 - DNA, 17 bp, Homo sapiens
gatccacactgagagag

SEQ ID NO: 238 - DNA, 17 bp, Homo sapiens
gatcaccttatggatgt

SEQ ID NO: 239 - DNA, 17 bp, Homo sapiens
gatctagttattttaat

SEQ ID NO: 240 - DNA, 17 bp, Homo sapiens
gatcattgagaatgcag

SEQ ID NO: 241 - DNA, 17 bp, Homo sapiens
gatcatgccaagtggtg

SEQ ID NO: 242 - DNA, 17 bp, Homo sapiens
gatcacattttctgttg

SEQ ID NO: 243 - DNA, 17 bp, Homo sapiens
gatcagaaagaaacctt

SEQ ID NO: 244 - DNA, 17 bp, Homo sapiens
gatccgtggcagggctg

SEQ ID NO: 245 - DNA, 17 bp, Homo sapiens
gatccgtggcagggctg

SEQ ID NO: 246 - DNA, 17 bp, Homo sapiens
gatctatcacccaaaca

SEQ ID NO: 247 - DNA, 17 bp, Homo sapiens
gatcaagcgtgctttcc

SEQ ID NO: 248 - DNA, 17 bp, Homo sapiens
gatcaagcgtgctttcc

SEQ ID NO: 249 - DNA, 17 bp, Homo sapiens
gatccctcatccctgaa

SEQ ID NO: 250 - DNA, 17 bp, Homo sapiens
gatccaccttggcctcc

SEQ ID NO: 251 - DNA, 17 bp, Homo sapiens
gatcttagggagacaaa

SEQ ID NO: 252 - DNA, 17 bp, Homo sapiens
gatcaagatacggaaga

SEQ ID NO: 253 - DNA, 17 bp, Homo sapiens
gatctgtttgttccctg

SEQ ID NO: 254 - DNA, 17 bp, Homo sapiens
gatcagcaaaagccaaa

SEQ ID NO: 255 - DNA, 17 bp, Homo sapiens
gatcgggggagggtaaa

SEQ ID NO: 256 - DNA, 17 bp, Homo sapiens
gatcgtggaggagggac

SEQ ID NO: 257 - DNA, 17 bp, Homo sapiens
gatcacttttgaaagca

SEQ ID NO: 258 - DNA, 17 bp, Homo sapiens
gatctgatttgctagtt

SEQ ID NO: 259 - DNA, 17 bp, Homo sapiens
gatcctagggggttttg

SEQ ID NO: 260 - DNA, 17 bp, Homo sapiens
gatctaagttgcctacc

SEQ ID NO: 261 - DNA, 17 bp, Homo sapiens
gatctttgttcttgacc

SEQ ID NO: 262 - DNA, 17 bp, Homo sapiens
gatctcttagccagagg

SEQ ID NO: 263 - DNA, 17 bp, Homo sapiens
gatctctctcacctaca

SEQ ID NO: 264 - DNA, 17 bp, Homo sapiens
gatcagaggtgaaggga

SEQ ID NO: 265 - DNA, 17 bp, Homo sapiens
gatctcattgatgtaca

SEQ ID NO: 266 - DNA, 17 bp, Homo sapiens
gatctgtgccggcttcc

SEQ ID NO: 267 - DNA, 17 bp, Homo sapiens
gatccgtctgtgcacat

SEQ ID NO: 268 - DNA, 17 bp, Homo sapiens
gatcggctctgggagac

SEQ ID NO: 269 - DNA, 17 bp, Homo sapiens
gatcgattaatgaagtg

SEQ ID NO: 270 - DNA, 17 bp, Homo sapiens
gatcctggactgggtac

SEQ ID NO: 271 - DNA, 17 bp, Homo sapiens
gatcttggagaatgtga

SEQ ID NO: 272 - DNA, 17 bp, Homo sapiens
gatctttttttggatat

SEQ ID NO: 273 - DNA, 17 bp, Homo sapiens
gatctagttattttaat

SEQ ID NO: 274 - DNA, 17 bp, Homo sapiens
gatctagttattttaat

SEQ ID NO: 275 - DNA, 17 bp, Homo sapiens
gatcaagggacggctga

SEQ ID NO: 276 - DNA, 17 bp, Homo sapiens
gatcagaaggctctggt

SEQ ID NO: 277 - DNA, 17 bp, Homo sapiens
gatcaatgttgaagaat

SEQ ID NO: 278 - DNA, 17 bp, Homo sapiens
gatcctgcactctaaca

SEQ ID NO: 279 - DNA, 17 bp, Homo sapiens
gatctgattatttactt

SEQ ID NO: 280 - DNA, 17 bp, Homo sapiens
gatccttgaaggcagct

SEQ ID NO: 281 - DNA, 17 bp, Homo sapiens
gatcccttttcttacta

SEQ ID NO: 282 - DNA, 17 bp, Homo sapiens
gatctgtccacttctgg

SEQ ID NO: 283 - DNA, 17 bp, Homo sapiens
gatcagataccaccaag

SEQ ID NO: 284 - DNA, 17 bp, Homo sapiens
gatcctttggattaatc

SEQ ID NO: 285 - DNA, 17 bp, Homo sapiens
gatcattatttctgtct

SEQ ID NO: 286 - DNA, 17 bp, Homo sapiens
gatcagccctcaaagaa

SEQ ID NO: 287 - DNA, 17 bp, Homo sapiens
gatcagcaaaaataaag

SEQ ID NO: 288 - DNA, 17 bp, Homo sapiens
gatctcagcggcattaa

SEQ ID NO: 289 - DNA, 17 bp, Homo sapiens
gatccctggagtgcctt

SEQ ID NO: 290 - DNA, 17 bp, Homo sapiens
gatctgtttctaccaat

SEQ ID NO: 291 - DNA, 17 bp, Homo sapiens
gatcctgctgtgaaagg

SEQ ID NO: 292 - DNA, 17 bp, Homo sapiens
gatcttgaaagtgcctg

SEQ ID NO: 293 - DNA, 17 bp, Homo sapiens
gatcaatacaataacaa

SEQ ID NO: 294 - DNA, 17 bp, Homo sapiens
gatctcctatgagaaca

SEQ ID NO: 295 - DNA, 17 bp, Homo sapiens
gatcaatacaataacaa

SEQ ID NO: 296 - DNA, 17 bp, Homo sapiens
gatctcctatgagaaca

SEQ ID NO: 297 - DNA, 17 bp, Homo sapiens
gatccaaccctgtactg

SEQ ID NO: 298 - DNA, 17 bp, Homo sapiens
gatctctaccatttaat

SEQ ID NO: 299 - DNA, 17 bp, Homo sapiens
gatccagaaatacttaa

SEQ ID NO: 300 - DNA, 17 bp, Homo sapiens
gatccaatgctaaactc

SEQ ID NO: 301 - DNA, 17 bp, Homo sapiens
gatcaaatgagaataaa

SEQ ID NO: 302 - DNA, 17 bp, Homo sapiens
gatccttgccacaagaa

SEQ ID NO: 303 - DNA, 17 bp, Homo sapiens
gatcagactgtattaaa

SEQ ID NO: 304 - DNA, 17 bp, Homo sapiens
gatctcccactgcgggg

SEQ ID NO: 305 - DNA, 17 bp, Homo sapiens
gatcggccctactagat

SEQ ID NO: 306 - DNA, 17 bp, Homo sapiens
gatcaaaaagcaagcag

SEQ ID NO: 307 - DNA, 17 bp, Homo sapiens
gatcacttcagctgcct

SEQ ID NO: 308 - DNA, 17 bp, Homo sapiens
gatcaccgactgaaaat

SEQ ID NO: 309 - DNA, 17 bp, Homo sapiens
gatcaatgaagtgagaa

SEQ ID NO: 310 - DNA, 17 bp, Homo sapiens
gatcatctcagaagtct

SEQ ID NO: 311 - DNA, 17 bp, Homo sapiens
gatcaggaaggacttgt

SEQ ID NO: 312 - DNA, 17 bp, Homo sapiens
gatcattcccatttcat

SEQ ID NO: 313 - DNA, 17 bp, Homo sapiens
gatcgctttctacactg

SEQ ID NO: 314 - DNA, 17 bp, Homo sapiens
gatcagttagcttttat

SEQ ID NO: 315 - DNA, 17 bp, Homo sapiens
gatcagtagttcaacag

SEQ ID NO: 316 - DNA, 17 bp, Homo sapiens
gatccgataagttattg

SEQ ID NO: 317 - DNA, 17 bp, Homo sapiens
gatcagtgggcacagtt

SEQ ID NO: 318 - DNA, 17 bp, Homo sapiens
gatcagtgccagaagtc

SEQ ID NO: 319 - DNA, 17 bp, Homo sapiens
gatcagagaagtaagtt

SEQ ID NO: 320 - DNA, 17 bp, Homo sapiens
gatctcactttcccctt

SEQ ID NO: 321 - DNA, 17 bp, Homo sapiens
gatcaggcagttcctgg

SEQ ID NO: 322 - DNA, 17 bp, Homo sapiens
gatccttgccacaagaa

SEQ ID NO: 323 - DNA, 17 bp, Homo sapiens
gatcaagaaaaataagg

SEQ ID NO: 324 - DNA, 17 bp, Homo sapiens
gatcgatttctttcctc

SEQ ID NO: 325 - DNA, 17 bp, Homo sapiens
gatcatagaaggctatt

SEQ ID NO: 326 - DNA, 17 bp, Homo sapiens
gatccggtgcgccatgt

SEQ ID NO: 327 - DNA, 17 bp, Homo sapiens
gatcgcagtttggaaac

SEQ ID NO: 328 - DNA, 17 bp, Homo sapiens
gatcaatttcaaaccct

SEQ ID NO: 329 - DNA, 17 bp, Homo sapiens
gatctcctatgagaaca

SEQ ID NO: 330 - DNA, 17 bp, Homo sapiens
gatcaatacaataacaa

SEQ ID NO: 331 - DNA, 17 bp, Homo sapiens
gatcctaccacctactg

SEQ ID NO: 332 - DNA, 17 bp, Homo sapiens
gatcatttgtttattaa

SEQ ID NO: 333 - DNA, 17 bp, Homo sapiens
gatcaaaatgctaaaac

SEQ ID NO: 334 - DNA, 17 bp, Homo sapiens
gatctggggtgggagta

SEQ ID NO: 335 - DNA, 17 bp, Homo sapiens
gatcatgcttgtgtgag

SEQ ID NO: 336 - DNA, 17 bp, Homo sapiens
gatcaaatatgtaaaat

SEQ ID NO: 337 - DNA, 17 bp, Homo sapiens
gatcagacttctcagct

SEQ ID NO: 338 - DNA, 17 bp, Homo sapiens
gatcatagaaggctatt

SEQ ID NO: 339 - DNA, 17 bp, Homo sapiens
gatccaccttggcctcc

SEQ ID NO: 340 - DNA, 17 bp, Homo sapiens
gatctctggcccctcag

SEQ ID NO: 341 - DNA, 17 bp, Homo sapiens
gatcctcattgagccac

SEQ ID NO: 342 - DNA, 17 bp, Homo sapiens
gatccagtggggtccgg

SEQ ID NO: 343 - DNA, 17 bp, Homo sapiens
gatcattttgtattaat

SEQ ID NO: 344 - DNA, 17 bp, Homo sapiens
gatcagaaaaagaaaga

SEQ ID NO: 345 - DNA, 17 bp, Homo sapiens
gatcctgttcctgtcac

SEQ ID NO: 346 - DNA, 17 bp, Homo sapiens
gatcatggttctctttg

SEQ ID NO: 347 - DNA, 17 bp, Homo sapiens
gatcctctgaccgctgg

SEQ ID NO: 348 - DNA, 17 bp, Homo sapiens
gatctgctattgccagc

SEQ ID NO: 349 - DNA, 17 bp, Homo sapiens
gatcctggaaattgcag

SEQ ID NO: 350 - DNA, 17 bp, Homo sapiens
gatcagtctcaagtgtc

SEQ ID NO: 351 - DNA, 17 bp, Homo sapiens
gatcaggttagcaaatg

SEQ ID NO: 352 - DNA, 17 bp, Homo sapiens
gatcagtatgctgtttt

SEQ ID NO: 353 - DNA, 17 bp, Homo sapiens
gatctggtttctagcaa

SEQ ID NO: 354 - DNA, 17 bp, Homo sapiens
gatctaattaaataaat

SEQ ID NO: 355 - DNA, 17 bp, Homo sapiens
gatcctgggtttttgtg

SEQ ID NO: 356 - DNA, 17 bp, Homo sapiens
gatcaccgactgaaaat

SEQ ID NO: 357 - DNA, 17 bp, Homo sapiens
gatcaggtaaccagagc

SEQ ID NO: 358 - DNA, 17 bp, Homo sapiens
gatcagtgaacactaac

SEQ ID NO: 359 - DNA, 17 bp, Homo sapiens
gatctcagatgctagaa

SEQ ID NO: 360 - DNA, 17 bp, Homo sapiens
gatcgctctgcccatgt

SEQ ID NO: 361 - DNA, 17 bp, Homo sapiens
gatcagctccgtggggc

SEQ ID NO: 362 - DNA, 17 bp, Homo sapiens
gatcattgcccaaagtt

SEQ ID NO: 363 - DNA, 17 bp, Homo sapiens
gatctggcactgtggtt

SEQ ID NO: 364 - DNA, 17 bp, Homo sapiens
gatctggcactgtgggt

SEQ ID NO: 365 - DNA, 17 bp, Homo sapiens
gatctcagatgctagaa

SEQ ID NO: 366 - DNA, 17 bp, Homo sapiens
gatcgctctgcccatgt

SEQ ID NO: 367 - DNA, 17 bp, Homo sapiens
gatctgctgtggaattg

SEQ ID NO: 368 - DNA, 17 bp, Homo sapiens
gatcgttcttgattttg

SEQ ID NO: 369 - DNA, 17 bp, Homo sapiens
gatcttggtttcatgtg

SEQ ID NO: 370 - DNA, 17 bp, Homo sapiens
gatcattcttgattttg

SEQ ID NO: 371 - DNA, 17 bp, Homo sapiens
gatccatatggaaagaa

SEQ ID NO: 372 - DNA, 17 bp, Homo sapiens
gatctgcccccactgtc

SEQ ID NO: 373 - DNA, 17 bp, Homo sapiens
gatcgcctagtatgttc

SEQ ID NO: 374 - DNA, 17 bp, Homo sapiens
gatcaatgctaatatga

SEQ ID NO: 375 - DNA, 17 bp, Homo sapiens
gatcagcatcaggctgt

SEQ ID NO: 376 - DNA, 17 bp, Homo sapiens
gatctggaagtgaaaca

SEQ ID NO: 377 - DNA, 17 bp, Homo sapiens
gatccacgtgtgaggga

SEQ ID NO: 378 - DNA, 17 bp, Homo sapiens
gatcacagaaaaattaa

SEQ ID NO: 379 - DNA, 17 bp, Homo sapiens
gatctctctgcgtttga

SEQ ID NO: 380 - DNA, 17 bp, Homo sapiens
gatctcagaagttttga

SEQ ID NO: 381 - DNA, 17 bp, Homo sapiens
gatccggactttttaaa

SEQ ID NO: 382 - DNA, 17 bp, Homo sapiens
gatcatagttattatac

SEQ ID NO: 383 - DNA, 17 bp, Homo sapiens
gatcctgccctgctctc

SEQ ID NO: 384 - DNA, 17 bp, Homo sapiens
gatcgattgagaagtta

SEQ ID NO: 385 - DNA, 17 bp, Homo sapiens
gatccaagtactctctc

SEQ ID NO: 386 - DNA, 17 bp, Homo sapiens
gatcatacacctgctca

SEQ ID NO: 387 - DNA, 17 bp, Homo sapiens
gatcctggatgccacga

SEQ ID NO: 388 - DNA, 17 bp, Homo sapiens
gatccctgccacaagtt

SEQ ID NO: 389 - DNA, 17 bp, Homo sapiens
gatcagacgaggccatg

SEQ ID NO: 390 - DNA, 17 bp, Homo sapiens
gatctttcaggaaagac

SEQ ID NO: 391 - DNA, 17 bp, Homo sapiens
gatcttttaaaaatata

SEQ ID NO: 392 - DNA, 17 bp, Homo sapiens
gatcgttttgttttgtt

SEQ ID NO: 393 - DNA, 17 bp, Homo sapiens
gatctatggcctctggt

SEQ ID NO: 394 - DNA, 17 bp, Homo sapiens
gatcctaaatcattttg

SEQ ID NO: 395 - DNA, 17 bp, Homo sapiens
gatctaagaagaaacta

SEQ ID NO: 396 - DNA, 17 bp, Homo sapiens
gatcttggtgttcaaaa

SEQ ID NO: 397 - DNA, 17 bp, Homo sapiens
gatccctcatccctgaa

SEQ ID NO: 398 - DNA, 17 bp, Homo sapiens
gatctgcagtgcttcac

SEQ ID NO: 399 - DNA, 17 bp, Homo sapiens
gatctatgcccttgtta

SEQ ID NO: 400 - DNA, 17 bp, Homo sapiens
gatctatgcccttgtta

SEQ ID NO: 401 - DNA, 17 bp, Homo sapiens
gatcagtttattattga

SEQ ID NO: 402 - DNA, 17 bp, Homo sapiens
gatctatgcccttgtta

SEQ ID NO: 403 - DNA, 17 bp, Homo sapiens
gatcagtttattattga

SEQ ID NO: 404 - DNA, 17 bp, Homo sapiens
gatctatgcccttgtta

SEQ ID NO: 405 - DNA, 17 bp, Homo sapiens
gatcagtttattattga

SEQ ID NO: 406 - DNA, 17 bp, Homo sapiens
gatcagtttattattga

SEQ ID NO: 407 - DNA, 17 bp, Homo sapiens
gatcgagtcaagatgag

SEQ ID NO: 408 - DNA, 17 bp, Homo sapiens
gatcaccatgatgcaga

SEQ ID NO: 409 - DNA, 17 bp, Homo sapiens
gatcccgtgtgtgtgtg

SEQ ID NO: 410 - DNA, 17 bp, Homo sapiens
gatcatggttctctttg

SEQ ID NO: 411 - DNA, 17 bp, Homo sapiens
gatccgcaggcagaagc

SEQ ID NO: 412 - DNA, 17 bp, Homo sapiens
gatcgatggtggcgctt

SEQ ID NO: 413 - DNA, 17 bp, Homo sapiens
gatctgcatcagttgta

SEQ ID NO: 414 - DNA, 17 bp, Homo sapiens
gatctctactaccacaa

SEQ ID NO: 415 - DNA, 17 bp, Homo sapiens
gatctctactaccacaa

SEQ ID NO: 416 - DNA, 17 bp, Homo sapiens
gatctctactaccacaa

SEQ ID NO: 417 - DNA, 17 bp, Homo sapiens
gatctctactaccacaa

SEQ ID NO: 418 - DNA, 17 bp, Homo sapiens
gatctctactaccacaa

SEQ ID NO: 419 - DNA, 17 bp, Homo sapiens
gatcgatggtggcgctt

SEQ ID NO: 420 - DNA, 17 bp, Homo sapiens
gatctttcaggaaagac

SEQ ID NO: 421 - DNA, 17 bp, Homo sapiens
gatcaaattgcaaaata

SEQ ID NO: 422 - DNA, 17 bp, Homo sapiens
gatcttattttctgaga

SEQ ID NO: 423 - DNA, 17 bp, Homo sapiens
gatccacaaggcctgag

SEQ ID NO: 424 - DNA, 17 bp, Homo sapiens
gatctaggcctcatctt

SEQ ID NO: 425 - DNA, 17 bp, Homo sapiens
gatccctttgaaatttt

SEQ ID NO: 426 - DNA, 17 bp, Homo sapiens
gatctacaacatataaa

SEQ ID NO: 427 - DNA, 17 bp, Homo sapiens
gatcagttttttcacct

SEQ ID NO: 428 - DNA, 17 bp, Homo sapiens
gatcacagtgtcagaga

SEQ ID NO: 429 - DNA, 17 bp, Homo sapiens
gatcgttactatgtgtc

SEQ ID NO: 430 - DNA, 17 bp, Homo sapiens
gatcattgacctctgtg

SEQ ID NO: 431 - DNA, 17 bp, Homo sapiens
gatctgaagcccaggtt

SEQ ID NO: 432 - DNA, 17 bp, Homo sapiens
gatctgttaaaaaaaaa

SEQ ID NO: 433 - DNA, 17 bp, Homo sapiens
gatctttcaggaaagac

SEQ ID NO: 434 - DNA, 17 bp, Homo sapiens
gatcataagacaatgga

SEQ ID NO: 435 - DNA, 17 bp, Homo sapiens
gatcagtctttattaat

SEQ ID NO: 436 - DNA, 17 bp, Homo sapiens
gatccaggctcactgtg

SEQ ID NO: 437 - DNA, 17 bp, Homo sapiens
gatcaaataatgcgacg

SEQ ID NO: 438 - DNA, 17 bp, Homo sapiens
gatcttggttttccatg

SEQ ID NO: 439 - DNA, 17 bp, Homo sapiens
gatctgttagtcaagtg

SEQ ID NO: 440 - DNA, 17 bp, Homo sapiens
gatcatttctggtaaat

SEQ ID NO: 441 - DNA, 17 bp, Homo sapiens
gatcaaagcactcttcc

SEQ ID NO: 442 - DNA, 17 bp, Homo sapiens
gatcatgccaagtggtg

SEQ ID NO: 443 - DNA, 17 bp, Homo sapiens
gatcatcgcctccctgg

SEQ ID NO: 444 - DNA, 17 bp, Homo sapiens
gatcaccaggctgccca

SEQ ID NO: 445 - DNA, 17 bp, Homo sapiens
gatcggatgggcaagtc

SEQ ID NO: 446 - DNA, 17 bp, Homo sapiens
gatctcaagaccaaaga

SEQ ID NO: 447 - DNA, 17 bp, Homo sapiens
gatctcacattgtgccc

SEQ ID NO: 448 - DNA, 17 bp, Homo sapiens
gatcagtctttattaat

SEQ ID NO: 449 - DNA, 17 bp, Homo sapiens
gatcagagaagatgata

SEQ ID NO: 450 - DNA, 17 bp, Homo sapiens
gatcaggtaaccagagc

SEQ ID NO: 451 - DNA, 17 bp, Homo sapiens
gatcatcagtaaatttg

SEQ ID NO: 452 - DNA, 17 bp, Homo sapiens
gatcaataaaatgtgat

SEQ ID NO: 453 - DNA, 17 bp, Homo sapiens
gatccctcgggttttgt

SEQ ID NO: 454 - DNA, 17 bp, Homo sapiens
gatcttgcaactccatt

SEQ ID NO: 455 - DNA, 17 bp, Homo sapiens
gatccagcatggaggcc

SEQ ID NO: 456 - DNA, 17 bp, Homo sapiens
gatcattgtgaaggcag

SEQ ID NO: 457 - DNA, 17 bp, Homo sapiens
gatctgccagcagtgtt

SEQ ID NO: 458 - DNA, 17 bp, Homo sapiens
gatcagaggttactagg

SEQ ID NO: 459 - DNA, 17 bp, Homo sapiens
gatccacaggggtggtg

SEQ ID NO: 460 - DNA, 17 bp, Homo sapiens
gatcacaagggggggat

SEQ ID NO: 461 - DNA, 17 bp, Homo sapiens
gatctctgttttgacta

SEQ ID NO: 462 - DNA, 17 bp, Homo sapiens
gatctaacctggcttgt

SEQ ID NO: 463 - DNA, 17 bp, Homo sapiens
gatcagcaagtgtcctt

SEQ ID NO: 464 - DNA, 17 bp, Homo sapiens
gatctagtggttcacac

SEQ ID NO: 465 - DNA, 17 bp, Homo sapiens
gatcaaacagtttctgg

SEQ ID NO: 466 - DNA, 17 bp, Homo sapiens
gatcatcaagaaaaaag

SEQ ID NO: 467 - DNA, 17 bp, Homo sapiens
gatcccagagagcagct

SEQ ID NO: 468 - DNA, 17 bp, Homo sapiens
gatcttgtgtatttttg

SEQ ID NO: 469 - DNA, 17 bp, Homo sapiens
gatctatgttctctcag

SEQ ID NO: 470 - DNA, 17 bp, Homo sapiens
gatcagcaagtgtcctt

SEQ ID NO: 471 - DNA, 17 bp, Homo sapiens
gatcatgtgctactggt

SEQ ID NO: 472 - DNA, 17 bp, Homo sapiens
gatctgtaaataaaatc

SEQ ID NO: 473 - DNA, 17 bp, Homo sapiens
gatcagggctgagggta

SEQ ID NO: 474 - DNA, 17 bp, Homo sapiens
gatcctcctatgttgtt

SEQ ID NO: 475 - DNA, 17 bp, Homo sapiens
gatcagagatgcaccac

SEQ ID NO: 476 - DNA, 17 bp, Homo sapiens
gatctgtctgttgcttg

SEQ ID NO: 477 - DNA, 17 bp, Homo sapiens
gatcaccatgaaagaag

SEQ ID NO: 478 - DNA, 17 bp, Homo sapiens
gatctgttaaaaaaaaa

SEQ ID NO: 479 - DNA, 17 bp, Homo sapiens
gatcaattcccttgaat

SEQ ID NO: 480 - DNA, 17 bp, Homo sapiens
gatcccagaccaaccct

SEQ ID NO: 481 - DNA, 17 bp, Homo sapiens
gatcatcacagtttgag

SEQ ID NO: 482 - DNA, 17 bp, Homo sapiens
gatcggaacagctcctt

SEQ ID NO: 483 - DNA, 17 bp, Homo sapiens
gatcggaacagctcctt

SEQ ID NO: 484 - DNA, 17 bp, Homo sapiens
gatcggaacagctcctt

SEQ ID NO: 485 - DNA, 17 bp, Homo sapiens
gatctgtgggcccagtc

SEQ ID NO: 486 - DNA, 17 bp, Homo sapiens
gatcaaccttaaaggaa

SEQ ID NO: 487 - DNA, 17 bp, Homo sapiens
gatcttctacttgcctg

SEQ ID NO: 488 - DNA, 17 bp, Homo sapiens
gatcaccagccatgtgc

SEQ ID NO: 489 - DNA, 17 bp, Homo sapiens
gatcaccggaggtcagt

SEQ ID NO: 490 - DNA, 17 bp, Homo sapiens
gatctattttatgcatg

SEQ ID NO: 491 - DNA, 17 bp, Homo sapiens
gatctgttaaaaaaaaa

SEQ ID NO: 492 - DNA, 17 bp, Homo sapiens
gatcattttggttcgtg

SEQ ID NO: 493 - DNA, 17 bp, Homo sapiens
gatcacttgtgtacgaa

SEQ ID NO: 494 - DNA, 17 bp, Homo sapiens
gatccctccacccccat

SEQ ID NO: 495 - DNA, 17 bp, Homo sapiens
gatccaaagtcatgtgt

SEQ ID NO: 496 - DNA, 17 bp, Homo sapiens
gatccataaatatttat

SEQ ID NO: 497 - DNA, 17 bp, Homo sapiens
gatctgcctgcatcctg

SEQ ID NO: 498 - DNA, 17 bp, Homo sapiens
gatccagtgtccatgga

SEQ ID NO: 499 - DNA, 17 bp, Homo sapiens
gatcaattcccttgaat

SEQ ID NO: 500 - DNA, 17 bp, Homo sapiens
gatccgtgtgcttgggc

SEQ ID NO: 501 - DNA, 17 bp, Homo sapiens
gatccagggtcccccag

SEQ ID NO: 502 - DNA, 17 bp, Homo sapiens
gatcatgggaccctctc

SEQ ID NO: 503 - DNA, 17 bp, Homo sapiens
gatcatgggaccctctc

SEQ ID NO: 504 - DNA, 17 bp, Homo sapiens
gatctcactgttattat

SEQ ID NO: 505 - DNA, 17 bp, Homo sapiens
gatcctgtatccaaatc

SEQ ID NO: 506 - DNA, 17 bp, Homo sapiens
gatcagttttctcttaa

SEQ ID NO: 507 - DNA, 17 bp, Homo sapiens
gatctaccagataacct

SEQ ID NO: 508 - DNA, 17 bp, Homo sapiens
gatcctagtaattgcct

SEQ ID NO: 509 - DNA, 17 bp, Homo sapiens
gatcaatgcaacgacgt

SEQ ID NO: 510 - DNA, 17 bp, Homo sapiens
gatcaattcccttgaat

SEQ ID NO: 511 - DNA, 17 bp, Homo sapiens
gatcaattcccttgaat

SEQ ID NO: 512 - DNA, 17 bp, Homo sapiens
gatcccagagggatgca

SEQ ID NO: 513 - DNA, 17 bp, Homo sapiens
gatcatcaaaaatgcta

SEQ ID NO: 514 - DNA, 17 bp, Homo sapiens
gatccctcgggttttgt

SEQ ID NO: 515 - DNA, 17 bp, Homo sapiens
gatcttgcaactccatt

SEQ ID NO: 516 - DNA, 17 bp, Homo sapiens
gatcttgttaatgcatt

SEQ ID NO: 517 - DNA, 17 bp, Homo sapiens
gatcaaaggtttaaagt

SEQ ID NO: 518 - DNA, 17 bp, Homo sapiens
gatcaccaagatgcttc

SEQ ID NO: 519 - DNA, 17 bp, Homo sapiens
gatcaaatgtgccttaa

SEQ ID NO: 520 - DNA, 17 bp, Homo sapiens
gatcttcggcctcattc

SEQ ID NO: 521 - DNA, 17 bp, Homo sapiens
gatcccttctgccctgg

SEQ ID NO: 522 - DNA, 17 bp, Homo sapiens
gatccaaccgactgaat

SEQ ID NO: 523 - DNA, 17 bp, Homo sapiens
gatctctgcagatgcca

SEQ ID NO: 524 - DNA, 17 bp, Homo sapiens
gatcacaaaatgttgcc

SEQ ID NO: 525 - DNA, 17 bp, Homo sapiens
gatctctctttctctct

SEQ ID NO: 526 - DNA, 17 bp, Homo sapiens
gatctctctttctctct

SEQ ID NO: 527 - DNA, 17 bp, Homo sapiens
gatctctctttctctct

SEQ ID NO: 528 - DNA, 17 bp, Homo sapiens
gatctctctttctctct

SEQ ID NO: 529 - DNA, 17 bp, Homo sapiens
gatcacaggcgtgagct

SEQ ID NO: 530 - DNA, 17 bp, Homo sapiens
gatcaacatcttttctt

SEQ ID NO: 531 - DNA, 17 bp, Homo sapiens
gatctctgatttaaccg

SEQ ID NO: 532 - DNA, 17 bp, Homo sapiens
gatctctctttctctct

SEQ ID NO: 533 - DNA, 17 bp, Homo sapiens
gatccatttttaatggt

SEQ ID NO: 534 - DNA, 17 bp, Homo sapiens
gatcttttctaaatgtt

SEQ ID NO: 535 - DNA, 17 bp, Homo sapiens
gatctctctttctctct

SEQ ID NO: 536 - DNA, 17 bp, Homo sapiens
gatcggtgcgttctcct

SEQ ID NO: 537 - DNA, 17 bp, Homo sapiens
gatcttttctaaatgtt

SEQ ID NO: 538 - DNA, 17 bp, Homo sapiens
gatcttttctaaatgtt

SEQ ID NO: 539 - DNA, 17 bp, Homo sapiens
gatctctctttctctct

SEQ ID NO: 540 - DNA, 17 bp, Homo sapiens
gatcctgttggatgtga

SEQ ID NO: 541 - DNA, 17 bp, Homo sapiens
gatctctctttctctct

SEQ ID NO: 542 - DNA, 17 bp, Homo sapiens
gatctctctttctctct

SEQ ID NO: 543 - DNA, 17 bp, Homo sapiens
gatcctgtgcttctgca

SEQ ID NO: 544 - DNA, 17 bp, Homo sapiens
gatctctctttctctct

SEQ ID NO: 545 - DNA, 17 bp, Homo sapiens
gatctgatgaagtatat

SEQ ID NO: 546 - DNA, 17 bp, Homo sapiens
gatcacttgtcttgtgg

SEQ ID NO: 547 - DNA, 17 bp, Homo sapiens
gatcttttctaaatgtt

SEQ ID NO: 548 - DNA, 17 bp, Homo sapiens
gatctctctttctctct

SEQ ID NO: 549 - DNA, 17 bp, Homo sapiens
gatctctctttctctct

SEQ ID NO: 550 - DNA, 17 bp, Homo sapiens
gatcagcactgccagtg

SEQ ID NO: 551 - DNA, 17 bp, Homo sapiens
gatccggaaagatgaat

SEQ ID NO: 552 - DNA, 17 bp, Homo sapiens
gatctctctttctctct

SEQ ID NO: 553 - DNA, 17 bp, Homo sapiens
gatctctctttctctct

SEQ ID NO: 554 - DNA, 17 bp, Homo sapiens
gatctaatgtaaaatcc

SEQ ID NO: 555 - DNA, 17 bp, Homo sapiens
gatcttcttttgtaatg

SEQ ID NO: 556 - DNA, 17 bp, Homo sapiens
gatcaataataatgagg

SEQ ID NO: 557 - DNA, 17 bp, Homo sapiens
gatcaacagtggcaatg

SEQ ID NO: 558 - DNA, 17 bp, Homo sapiens
gatcaacagtggcaatg

SEQ ID NO: 559 - DNA, 17 bp, Homo sapiens
gatcaataataatgagg

SEQ ID NO: 560 - DNA, 17 bp, Homo sapiens
gatcattgctccttctc

SEQ ID NO: 561 - DNA, 17 bp, Homo sapiens
gatctctgcattttata

SEQ ID NO: 562 - DNA, 17 bp, Homo sapiens
gatctatgaaatctgtg

SEQ ID NO: 563 - DNA, 17 bp, Homo sapiens
gatctctctttctctct

SEQ ID NO: 564 - DNA, 17 bp, Homo sapiens
gatcactggagctgtgg

SEQ ID NO: 565 - DNA, 17 bp, Homo sapiens
gatcatccagtttgctt

SEQ ID NO: 566 - DNA, 17 bp, Homo sapiens
gatcaaaattgttaccc

SEQ ID NO: 567 - DNA, 17 bp, Homo sapiens
gatcaacagtggcaatg

SEQ ID NO: 568 - DNA, 17 bp, Homo sapiens
gatcaataataatgagg

SEQ ID NO: 569 - DNA, 17 bp, Homo sapiens
gatcaacagtggcaatg

SEQ ID NO: 570 - DNA, 17 bp, Homo sapiens
gatcaataataatgagg

SEQ ID NO: 571 - DNA, 17 bp, Homo sapiens
gatccatactgtttgga

SEQ ID NO: 572 - DNA, 17 bp, Homo sapiens
gatctgcattttcagaa

SEQ ID NO: 573 - DNA, 17 bp, Homo sapiens
gatcccattttttggta

SEQ ID NO: 574 - DNA, 17 bp, Homo sapiens
gatctgcagtgcttcac

SEQ ID NO: 575 - DNA, 17 bp, Homo sapiens
gatctgttaaaaaaaaa

SEQ ID NO: 576 - DNA, 17 bp, Homo sapiens
gatcataggtctggaca

SEQ ID NO: 577 - DNA, 17 bp, Homo sapiens
gatctaatactactgtc

SEQ ID NO: 578 - DNA, 17 bp, Homo sapiens
gatctcttgaggctggg

SEQ ID NO: 579 - DNA, 17 bp, Homo sapiens
gatcgttcattgccttt

SEQ ID NO: 580 - DNA, 17 bp, Homo sapiens
gatctctctttctctct

SEQ ID NO: 581 - DNA, 17 bp, Homo sapiens
gatctgacctggtgaga

SEQ ID NO: 582 - DNA, 17 bp, Homo sapiens
gatcatctttcctgttc

SEQ ID NO: 583 - DNA, 17 bp, Homo sapiens
gatcgtaaaattttaag

SEQ ID NO: 584 - DNA, 17 bp, Homo sapiens
gatctctctttctctct

SEQ ID NO: 585 - DNA, 17 bp, Homo sapiens
gatctctctttctctct

SEQ ID NO: 586 - DNA, 17 bp, Homo sapiens
gatctctctttctctct

SEQ ID NO: 587 - DNA, 17 bp, Homo sapiens
gatctctctttctctct

SEQ ID NO: 588 - DNA, 17 bp, Homo sapiens
gatctctctttctctct

SEQ ID NO: 589 - DNA, 17 bp, Homo sapiens
gatctctctttctctct

SEQ ID NO: 590 - DNA, 17 bp, Homo sapiens
gatccggaaagatgaat

SEQ ID NO: 591 - DNA, 17 bp, Homo sapiens
gatccggaaagatgaat

SEQ ID NO: 592 - DNA, 17 bp, Homo sapiens
gatctctgtaattttat

SEQ ID NO: 593 - DNA, 17 bp, Homo sapiens
gatctaagagattaata

SEQ ID NO: 594 - DNA, 1173 bp, Homo sapiens
gtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaa

SEQ ID NO: 595 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 596 - DNA, 642 bp, Homo sapiens
tcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggaaaaaa

SEQ ID NO: 597 - protein, 173 aa, Homo sapiens
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 598 - DNA, 7682 bp, Homo sapiens
gggccggggggcggagccttgcgggctggatctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 599 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 600 - DNA, 7678 bp, Homo sapiens
gggccggggggcggagccttgcgggctggagcgaaagaatgcgggggctgagcgcagaagcggctcgaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 601 - protein, 128 aa, Homo sapiens; identical to SEQ ID NO: 599

SEQ ID NO: 602 - DNA, 7794 bp, Homo sapiens
gggccggggggcggagccttgcgggctggagcgaaagaatgcgggggctgagcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 603 - protein, 128 aa, Homo sapiens; identical to SEQ ID NO: 599

SEQ ID NO: 604 - DNA, 7633 bp, Homo sapiens
gggccggggggcggagccttgcgggctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 605 - protein, 128 aa, Homo sapiens; identical to SEQ ID NO: 599

SEQ ID NO: 606 - DNA, 760 bp, Homo sapiens
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaa

SEQ ID NO: 607 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 608 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 609 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 610 - DNA, 2836 bp, Homo sapiens
ctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaagcatccttgaaatcatgcttgaatattgctttgatagctgctatcatgacccctttttaaggcaattctaatctttcataactacatctcaattagtggctggaaagtacatggtaaaacaaagtaaatttttttatgttctttttttggtcacaggagtagacagtgaattcaggtttaacttcaccttagttatggtgctcaccaaacgaagggtatcagctatttttttttaaattcaaaaagaatatcccttttatagtttgtgccttctgtgagcaaaactttttagtacgcgtatatatccctctagtaatcacaacattttaggatttagggatacctgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgtccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgctaaaaaaaaaaaaaaaaaaaaaaaaaaaa

SEQ ID NO: 611 - protein, 228 aa, Homo sapiens
MLSRCRSGLLHVLGLSFLLQTRRPILLCSPRLMKPLVVFVLGGPGAGKGTQCARIVEKYGYTHLSAGELLRDERKNPDSQYGELIEKYIKEGKIVPVEITISLLKREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVQIFDKEG

SEQ ID NO: 612 - DNA, 3884 bp, Homo sapiens
cactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcgaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagggcatcccaggaaatcagcttctagatctagctctgccactaactgctgttgattaaacctgtcactttacacatgaaaaagcttgaaacttagagaaagataaaattgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgttcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccattttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaaaaaaaaaaaaaaaaagaaaaaaaaaaaaaaaa

SEQ ID NO: 613 - protein, 467 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRESYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGHPRKSASRSSSATNCC

SEQ ID NO: 614 - DNA, 1363 bp, Homo sapiens
ggcacagcaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggcttgctttgcatctctggtgagtcaggactatgtcaatggcaccgatcaggaagaaattcgaaccggtgttgatcagtgtatccagaagtttctggatattgcaagacagacagaatgttttttcttacaaaaaagattgcagttatctgtccagaaaccagagcaagttatcaaagaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcaaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacataaaaggatatagtgggagcagtgatacgctaacattcattacattctgcagtaatgaatctgaaaaaaaaaaaaaaaaaaaaaaaaaaaaaaaaaaaaaaaaaaaaaaaaaaaaaaaaaaaaaaaaaaaaaaaaaaa

SEQ ID NO: 615 - protein, 178 aa, Homo sapiens
MAAPLGGMFSGQPPGPPQAPPGLPGQASLLQAAPGAPRPSSSTLVDELESSFEACFASLVSQDYVNGTDQEEIRTGVDQCIQKFLDIARQTECFFLQKRLQLSVQKPEQVIKEDVSELRNELQRKDALVQKHLTKLRHWQQVLEDINVQHKKPADIPQGSLAYLEQASANIPAPLKPT

SEQ ID NO: 616 - DNA, 903 bp, Homo sapiens
catgctgaaagcagggcgggaccggggcggtcttccagcagggaaaatggcgctggccatgctggtcttggtggtttcgccgtggtctgcggcccggggagtgcttcgaaactactgggagcgactgctacggaagcttccgcagagccggccgggctttcccagtcctccgtggggaccagcattagcagtacagggcccagccatgtttacagagccagcaaatgataccagtggaagtaaagagaattccagccttttggacagtatcttttggatggcagctcccaaaaatagacgcaccattgaagttaaccggtgtaggagaagaaatccgcagaagcttattaaagttaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacaggagagacaccgtctgaacaagatcagggcaagaggatcattgaacgagacagaaagcgaccatcctggttcacccagaattgacaccaaagatgttaaaaggataacttcacagtaaatcatttctcctgaaatagaggaagattctttacgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaaaaaaaaaaa

SEQ ID NO: 617 - protein, 188 aa, Homo sapiens [sequence omitted]

SEQ ID NO: 618 - DNA, 1957 bp, Homo sapiens
cccggggccgcggagccgggccggggcagcgccgtctccgcctcggggccgccgggggcgccctgctgagcgctacccacgtgcgtccgcgccacctcgcgggcgaccccgcggccaaggcccccggcggagcggctcccgggcgccccgaactagcccccaactttgggcgaagtttgcctgcgcctctccccgcccccacgcggcgcgccggggccgcggacggcagcggcccccggggatgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccacgggaagccctgcgtctgccgctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagcatattctcatctctggccccgaggctgcctgtggggcgagtggagacctcccatcactgagacagatcacagaccacgagtgcctttcccggacctggacgttgcctccagagcaggcaccagctctttccctctctacacagaaatatttttgtaaggttctggggcagggagggagcatgaagtacgaggaaaacttgaattccagatttttagtgcaaagtatttatcatttctaccagaaataaacgttttaagtttttacttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 619 - protein, 273 aa, Homo sapiens
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 620 - DNA, 859 bp, Homo sapiens
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaaca

SEQ ID NO: 621 - protein, 137 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKDVTDFISHLFMQLGTVGIYDLPHLRNKLVIK

SEQ ID NO: 622 - DNA, 889 bp, Homo sapiens
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctg

SEQ ID NO: 623 - protein, 117 aa, Homo sapiens
MPRLFFFHLLGVCLLLNQFSRAVADSWMEEVIKLCGRELVRAQIAICGMSTWSKRSLSQEDAPQTPRPVAGDFIQTVSLGISPDGGKALRTGSCFTREFLGALSKLCHPSSTKIQKP

SEQ ID NO: 624 - DNA, 2521 bp, Homo sapiens
ggccgggacggggcagggcgaacctgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcatcgttcctggaaatgtgaccctcagtgtcatgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactcttttttttttttgtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgctttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatctgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcggacagttaaaaaaaaaa

SEQ ID NO: 625 - protein, 193 aa, Homo sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 626 - DNA, 921 bp, Homo sapiens
gacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcaaaaaaaaaaaaaaaaaaaaaaaaa

SEQ ID NO: 627 - protein, 151 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 628 - DNA, 1214 bp, Homo sapiens
acggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccaaaaaaaaaaaaaaa

SEQ ID NO: 629 - protein, 156 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 630 - DNA, 2678 bp, Homo sapiens
tagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaaaaaaaaaaaaaaaaaaaaaaaaaaaaaaaaaaaaa

SEQ ID NO: 631 - protein, 77 aa, Homo sapiens
MFHPNVYADGSICLDILQNRWSPTYDVSSILTSIQSLLDEPNPNSPANSQAAQLYQENKREYEKRVSAIVEQSWRDC

SEQ ID NO: 632 - DNA, 538 bp, Homo sapiens
ccgtgtctccacacgtctgcctccatcactgccatcgcgatcctgcagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacacccacaataaaaacctgaaaaccaaaaaaaaaaaaaaaaa

SEQ ID NO: 633 - protein, 112 aa, Homo sapiens
MSYPVTSQPQCATTSCYQTQLSDWHTGLTDCCNDMPVCLCGTFAPLCLACRISDDFGECCCAPYLPGGLHSIRTGMRERYHIQGSVGHDWAALTFCLPCALCQMARELKIRE

SEQ ID NO: 634 - DNA, 1264 bp, Homo sapiens
cagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggaacacttgaggtcaggagttcaagaccagcctggccaacatggtgaaacctcgtctctactaaaaatacaaaaatcaaccaggcatgacggtgcacgcctgttatcacagctacttgggaggcagcggctggagaattgcttgaacctgggaagtcgaggctgcaagtgagctgagatcatgccatggcagtctagcctgggcaacagagcgagactctgtttcaaaaaaaaaaaaaaaaaaaaaaaaaaaaaaaaaaaaa

SEQ ID NO: 635 - protein, 199 aa, Homo sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDPE

SEQ ID NO: 636 - DNA, 1282 bp, Homo sapiens
ctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaa

SEQ ID NO: 637 - protein, 339 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 638 - DNA, 1076 bp, Homo sapiens
gccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttccttaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacaaaaaaaaaaaaaaaaaaa

SEQ ID NO: 639 - protein, 46 aa, Homo sapiens
MNLQKVSPVPSSRWRVTWPRAARKRNISSNDSQAPRSLFLAPSLTR

SEQ ID NO: 640 - DNA, 1704 bp, Homo sapiens
gaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttcaaaaaaaaaaaaaaaaaa

SEQ ID NO: 641 - protein, 378 aa, Homo sapiens
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 642 - DNA, 2788 bp, Homo sapiens
aaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgatgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccacattcttcagtccctggcgaccaccatatttttaagtcattatgactctgactattcttggtacttctcagaagaagaatcttagagtgtttttcattattttttttcacttaggataatatcctcaaagttcatccattttttagcatgtgtcagaaattttaaggctgagcaatatttcattgtttgcatttaccacatttcctttatttctgacatctattcatggacacttgggttacttctacctctggctattgtgaatattgctactacaagcataagggcacaaatatctctttgagaccctgctttcaattcttattgggtaccccaaaaagtggaactgctggatcacatggtacttctaactttaattctttgatgaactgagaaacttttccataaaacttgcaccgttttacattcctaacattccacaaaagttgtgatttgtcctcattctaatccatagaaggcaacatttctaacaggtttctaggtgattttgttgttgctgatgtagggactacattttgagaactgtcctatcccatttttataacaatgcagagcttctctgtaaataccccttgtttctatgttctatcctgtgagccttttcattttgttaatttttcccagtgtttacaaccaggaaatagcttgtcatctttgatacaaaacagaaatctttgcaaaaaaaaaaaaaaaa

SEQ ID NO: 643 - protein, 402 aa, Homo sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVHTGERPYECSECGKAFLTKSHLICHQTVHTAAKQCSECGKFFRYNSTLLRHQKVHTG

SEQ ID NO: 644 - DNA, 616 bp, Homo sapiens
atgcattctgcaagccaccctggggtgcagctgagctagacatgggacggcgagacgcccagctcctggcagcgctcctcgtcctggggctatgtgccctggcggggagtgagaaaccctccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaaaaaaaaaaa

SEQ ID NO: 645 - protein, 129 aa, Homo sapiens
MGRRDAQLLAALLVLGLCALAGSEKPSPCQCSRLSPHNRTNCGFPGITSDQCFDNGCCFDSSVTGVPWCFHPLPKQESDQCVMEVSDRRNCGYPGISPEECASRKCCFSNFIFEVPWCFFPKSVEDCHY

SEQ ID NO: 646 - DNA, 388 bp, Homo sapiens
ctgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaggatccagctgcctatgaaaatgacaaatgagcaacgcatccggatgacggttccctgtctctgaaagacctttctctggaagaggagtctgcattgtagtgtctcaaagacacaataaacttcctatggtctga

SEQ ID NO: 647 - protein, 93 aa, Homo sapiens
MGREFGNLTRMRHVISYSLSPFEQRAYPHVFTKGIPNVLRRIRESFFRVVPQFVVFYLIYTWGTEEFERSKRRIQLPMKMTNEQRIRMTVPCL

SEQ ID NO: 648 - DNA, 2048 bp, Homo sapiens
ggcggggcctgggcgcgccgagctccggctgggtccctgcaggtcttggggcccgggactcttcctggagacaccgccatggccgggctatcccgcgggtccgcgcgcgcactgctcgccgccctgctggcgtcgacgctgttggcgctgctcgtgtcgcccgcgcggggtcgcggcggccgggaccacggggactgggacgaggcctcccggctgccgccgctaccaccccgcgaggacgcggcgcgcgtggcccgcttcgtgacgcacgtctccgactggggcgctctggccaccatctccacgctggaggcggtgcgcggccggcccttcgccgacgtcctctcgctcagcgacgggcccccgggcgcgggcagcggcgtgccctatttctacctgagcccgctgcagctctccgtgagcaacctgcaggagaatccatatgctacactgaccatgactttggcacagaccaacttctgcaagaaacatggatttgatccacaaagtcccctttgtgttcacataatgctgtcaggaactgtgaccaaggtgaatgaaacagaaatggatattgcaaagcattcgttattcattcgacaccctgagatgaaaacctggccttccagccataattggttctttgctaagttgaatataaccaatatctgggtcctggactactttggtggaccaaaaatcgtgacaccagaagaatattataatgtcacagttcagtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgtttaagaaaaataatttatactaaatttagtaaaatggacttcttattcaaagcatcaataattaaaagaattattttaatgaaaaaaaaaaaaaaaaaaaaaaaaa

SEQ ID NO: 649 - protein, 220 aa, Homo sapiens
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 650 - DNA, 5040 bp, Homo sapiens
ggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaaaaaaaaaaaaaaaa

SEQ ID NO: 651 - protein, 220 aa, Homo sapiens
MAGAIASRMSFSSLKRKQPKTFTVRIVTMDAEMEFNCEVKKQILDEKIYCPPEASVLLASYAVQAKNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQGQRGRSAEAGPAGSTRGGAKSQAEAPGDCHQAHVPAHEPNSSTVAS

SEQ ID NO: 652 - DNA, 1773 bp, Homo sapiens
gtttctctccctgcccccgcgacttcgcgcaagatccgggaaggacacccgaggcccctgggagaccctggggaggtgaaagtcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctgggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaaaaaaa

SEQ ID NO: 653 - protein, 228 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGVHSGLLLHPLLRGCPAGRGPLLSQLQSSPGHLQAFVGLSQTWREPGAAGSPFHLSSSFTPGGGSALVVSPLQGAHLHVFFWGEYVAKLTNLQTPEIAAWSRA

SEQ ID NO: 654 - DNA, 1167 bp, Homo sapiens
tgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccgggtaagacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccgaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgaaaaaaaa

SEQ ID NO: 655 - protein, 108 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 656 - DNA, 2937 bp, Homo sapiens
gggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccggcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccaccgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaaaaaaaaaaaaaa

SEQ ID NO: 657 - protein, 445 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

SEQ ID NO: 658 - DNA, 1466 bp, Homo sapiens
atactcaccaggatacccctcgttaagggcaaggcggcttctggctcttccgcaggctcagttgtgggttcctgtgtgcttagtcatcgggtccgacacaggctggactgatctggagagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggaacaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgaaaaaaaaaaaaaaaaaaaaaaaaaa

SEQ ID NO: 659 - protein, 123 aa, Homo sapiens
MALNNVSLSSGDQRSRVAYRSSHGDLRPRASALAMVSGDGFLVSRPEAIHLGPRQAVRPSVRAESRRVDGGGRSPREPDGRGRSRQARFSPYPIPAVEPDLLRSVLQQRLIALGGVIAARISV

SEQ ID NO: 660 - DNA, 2030 bp, Homo sapiens
ggcggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagaaaaaaaaaaaaaaaaaaaa

SEQ ID NO: 661 - protein, 198 aa, Homo sapiens
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 662 - DNA, 823 bp, Homo sapiens
gggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctctt

SEQ ID NO: 663 - protein, 81 aa, Homo sapiens
MLRQIIGQAKKHPSLIPLFVFIGTGATGATLYLLRLALFNPDVCWDRNNPEPWNKLGPNDQYKFYSVNVDYSKLKKERPDF

SEQ ID NO: 664 - DNA, 1200 bp, Homo sapiens
gaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtaactgggggaaggtgatggggcgggggtccccctcaaccgcagacttcaggctgctttgtcctcatctaatctcctctccaattcccactcctcatgctcacctcccctaccctgctgcatggacacctgctcacccctgcctcatctgtactccccagatctcctggctgcaaatcagcccatcggcagtgtttcttgagctcccagtaggggctggccacggccaggtgtgggagggacttcgaagataagagtgagcggctgcctccgggagcttacatcctagctggggagcagagttagggtgcacgctatggcgcacacacacagtgcacgtccacagtgccataccacggggcatggtggctcatgcctgtaatcccagcactttggtaggctgaggtgggtggattacttgaggtcaggagttcaaaaccagcctggccaacatggtgaaaccctgtctctactaaaaatcccaaaaaaaaaaaaaaaaaaaaaaaaaa

SEQ ID NO: 665 - protein, 128 aa, Homo sapiens
MSMAVETFGFFMATVGLLMLGVTLPNSYWRVSTVHGNVITTNTIFENLWFSCATDSLGVYNCWEFPSMLALSGSTDSPASLSGGTGLLVRLMSIKGPCEGRRLASCRLSVRCKEAVCVQGIFRPAGHS

SEQ ID NO: 666 - DNA, 1200 bp, Homo sapiens
cagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaaaaaaaaaa

SEQ ID NO: 667 - protein, 98 aa, Homo sapiens
  VARIANT 49: Xaa - selenocysteine
MCAARLAAAAAAAQSVYAFSARPLAGGEPVSLGSLRGKVLLIENVASLXGTTVRDYTQMNELQRRLGPRGLVVLGFPCNQFGHQVRRAERGGAGADVQ

SEQ ID NO: 668 - DNA, 987 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 669 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 670 - DNA, 1108 bp, Homo sapiens
agacccgcccgcccgagccggagttacaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcatcaaaaaaaaaaaaaaaaaa

SEQ ID NO: 671 - protein, 149 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 672 - DNA, 794 bp, Homo sapiens
ggcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccagctctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgttggtatggtcaccataataatgaatgactatccaaaattcaagtatgctcttttggctgtaatgggtgcatatgtgttactaaaacgtgaatcctaaaatgagaagcagttcctgggaccagattgaaatgaattctgttgaaaaagagaaaaactaatatatttgagatgttccattttctgtataaaagggaacagtgtggagatgtttttgtcttgtccaaataaaagattcaccagtaaaaaaaaaaaaaa

SEQ ID NO: 673 - protein, 192 aa, Homo sapiens
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 674 - DNA, 2371 bp, Homo sapiens
atccgcagccaactgtgtggcggtccccactttcgcctagcggcaactccctccctccctgcaatccttccttcttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaaggatcccaaacttgtaactaaattctgacatatctgttactgctgactcacattcattctccgccattcaaatactattttttatccacattttttttttgttccccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctaaaaaaaaaaaaaaaaaa

SEQ ID NO: 675 - protein, 265 aa, Homo sapiens
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 676 - DNA, 2467 bp, Homo sapiens
aaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccaggccagtcccaatccccggcccgtccgggatgaggggggctgcgggagctgcgggggcctcctccagggaggacggttgcagggtccctcggccgccgcccactcccgggggcgttccttcctcccagctgcgcccggagcgcctgctgcctggcgagagcccgcccctctgcaaccagcccgctgcagcggagggcgcctgggtgccctcggccgagccagcagcccacggtcggcgccgcactgtcccctggtggcggagcgctcccgcgacccggctcgccacgcctgggaggggtccaggaggacgcggctgggacctgggggctctcagggtggggccttgggggatgaggctggggcccgcgggaaaccgggctggggcgaggaggctcgcaggacttcctgccacagaatgtttcgatgctgtttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatattcgtgctttccttgggaaagaacggagatttttcccggaatcaagaaacccctttttttctgtccgttcttggtctcttccagtcgttgtcatggcgacatgttgtttagcatgagaacaggatgatgataaagccagaggctcttcagaggcgccatcttggatttcgccagcttcagctggtttcgtcctaagaaggaacttcgaaacacaggcattctttttcctgaaaataagcagttacagctgagtaggaatttagctctgtcccatatgctatcgcattgggcagcaaaagcagggtggggtccagcgaaatcagcaggcactgcaatgagtaacatacccagctacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaaacttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaatgcctgcctgactgaagcttaatgatgtgaggcttctagtgtgataccctaccttgttttaacctgaagtgactcttccttagctaagagagccagacggactccatcgtgactccttcactcgcagcccctcacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagattccccctctcccctgtctaaaccaaagtataaaagaaaatctagctccttcttcggggccaagagaattttgagcgctagctgtctctcggctgccggctaataaaggactcctgaattcgt

SEQ ID NO: 677 - protein, 155 aa, Homo sapiens
MRGAAGAAGASSREDGCRVPRPPPTPGGVPSSQLRPERLLPGESPPLCNQPAAAEGAWVPSAEPAAHGRRRTVPWWRSAPATRLATPGRGPGGRGWDLGALRVGPWGMRLGPAGNRAGARRLAGLPATECFDAVFNSANVSLSTLSPSSAQRTVL

SEQ ID NO: 678 - DNA, 3028 bp, Homo sapiens
ctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacacacattgttgtgtggtgctttaaactaggtccactatcaacaggctacttactgttcaagaattccactgaagcacttattttaaggccctatttttcttaaacaaaacagtgacaacaacaatcaaaccatttacttttgatgctcattggcattttatgataaaagatgtattcatggcaatgatatgtattcaccctattaggaaacacaactggttacctatgagacctgttctgtccgtgtgcctacgttccttaataatagctaaataaaaatttgtagcttttaaaaaaaaaaaaaaaaaa

SEQ ID NO: 679 - protein, 206 aa, Homo sapiens
MEVDINGESRSTLTTLPFPGAEANSPGKAEAEKPRCSSTPCSPMRRTVSGYQILHMDSNYLVGFTTGEELLKLAQKCTGGEESKAEAMPSLRSKQLDAGLARSSRLYKTRSRYYQPYEIPAVNGRRRRRMPSSGDKCTKSLPYEPYKALHGPLPLCLLKGKRAHSKSLDYLNLDKMIKEPADTEVLQYQLQHLTLRGDRVFARNNT

SEQ ID NO: 680 - DNA, 1415 bp, Homo sapiens
ggggaagggagaggagcatgtctgcaactcgagccaagaaagtgaagatggccaccaaatcatgccccgagtgcgaccaacaggttcctgttgcatgtaaatcatgtccttgtggttacatatttattagcagaaaacttttaaatgcaaaacactcagagaaatcaccaccttctacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagagagaaacaggaaaaggaaattgacatctatgctaacctgtctgatgaaaaggctttcgtgttttcagtcgccttggcagaaataaatagaaaaattatcaatcaaagacttattctctgatacttgtttgcaaaatctgctgaaacttctgtcaggataacatcagcaaattctcaaacagttatggactctcaggagcattctgactgcatcaataagggccatcgattgtttctttctcgcctgtcgtttagcctgtgccacacttcgggagcaaagctgtgtaggcttggactgttctgggatttccttgtttaccaaggagtattgtcagtgttttgtgtttgggatataagtaagtgtatttgccaacaacaaaaaaaaaccaacaaaaatgctggatggatgttaaaggataaaaagtgatggggtatggggtaggtatgaaaactagggtaataagatgcttgattgttttcaggtttgccaccagagatgcaatattttaaatactgtcagaaagagtgatttttaaaaatatatatttcagattttcagtgctaacagattgcatatatacagttcatttacttttattaaattggcaatcgatattttattgaatggggaattaagaatataaactgtaaattttgtcttaaattgattttttttcttggcctttatttttattacttaaggtatgagttatattttaggagatactttctagacagtttgaagtttgggtgctatatgaagaaaaacatttaatgatatactcagatataaacaccttgttttcttgaatgtaatttatttattagctaaaaaaaaaaaacaaactgctctcaagatggtgcctgttaacctaaacatgaaatatatttattacatgcaaaatatttcttagccacttttaagcagtaatgttttatctgaatggatatttgtttctatatcctgataattatttaaattgttactttcaatctggaagaaaaaataaaccttaatattgaaaccaaaaaaaaaaaaaaaaaaaaaaaaaaa

SEQ ID NO: 681 - protein, 154 aa, Homo sapiens
MSATRAKKVKMATKSCPECDQQVPVACKSCPCGYIFISRKLLNAKHSEKSPPSTENKHEAKRRRTERVRREKINSTVNKDLENRKRSRSNSHSDHIRRGRGRPKSASAKKHEEEREKQEKEIDIYANLSDEKAFVFSVALAEINRKIINQRLIL

SEQ ID NO: 682 - DNA, 3007 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccacaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaatt

SEQ ID NO: 683 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 684 - DNA, 4745 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaaaaaaaaaaaaa

SEQ ID NO: 685 - protein, 115 aa, Homo sapiens
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQA

SEQ ID NO: 686 - DNA, 941 bp, Homo sapiens
gcagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctacaagctcctgcttttggctttaccatatgttgtgtctaatctccttctgagaaggacgagaaactttcttccaagtgaagatccatttaagaacacatgtatttacatgcctataatatgctggttgtgtatgctttgtcttttaagttattaaaggaacgtctagaaaaa

SEQ ID NO: 687 - protein, 158 aa, Homo sapiens
MLLLDCNPEVDGLKHLLETGASVNAPPDPCKQSPVHLAAGSGLACFLLWQLQTGADLNQQDVLGEAPLHKAAKVGSLECLSLLVASDAQIDLCNKNGQTAEDLAWSCGFPDCAKFLTTIKCMQTIKASEHPDRNDCVAVLRQKRSLGSVENTSGKRKC

SEQ ID NO: 688 - DNA, 1470 bp, Homo sapiens
agagccgccagcgaggctggggatgggggcgccgctgctctctcccggctggggagccggggctgccggccggcgctggtggatgctgctggcgcccctgctgccggcgctgctgctggtgcggcccgcgggggccctggtggaggggctctactgcggcacgcgggactgctacgaggtgctgggcgtgagccgctcggcgggcaaggcggagatcgcgcgggcctaccgccagctggcccggcgctaccaccctgaccgctaccggccccagcccggagacgagggccccgggcggacgccgcagagcgccgaggaggctttcctgctggtggcaaccgcctacgagacactcaaggtctctcaggcagctgcagagcttcaacagtactgtatgcagaatgcctgcaaggatgccctgctggtgggtgttccagctggaagtaaccccttccgggagcctagatcctgtgctttactctgaagactcgagagaagtttgctgaggaatgccttcaagcacaaagtgatgaatgactgccttcaagtctcaagaaaacacttttccctaacttttagagatatttcagccctttcctgtggcctggtcctatagccaaaatcacagatattcatgagtttctacttgagtgagaaaactgggtgaaggaatagaattttaaatagtaataactgcttgttttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaactgaatacttataaactgttgttcctggaagttatttattccataaaaaatttgttcttttgtcatgaatttataattcctaaatgaagaccagaaagtacaaattgctgggaggaagaataggctttattaatcaactgatgtcttgatttttctaaatgggaagattgctttatttttaacactaattatgggagcagattcttagcaaacttctttggaaaagttaatgttatgatgtgcattaggctgccccatcgtgtatataaatgaagcagatttgatttttgtattcttacgtttctctgctttgtagttgtggctgtacttaaagaaatacagaatttcatatatttaaaaatgtttaaaatgtgacccacagaacattgtaaatgattaaaaactaacatgaaaatattacaacctaaaagaattcttaacttcacaagtgttttacttcgacgatgtgcctttgatttaatttgggacacttttttagaaggatacattattcgtgtttgcaacggtctttgaagagcttggaaataaaatttctgcttaattaatcaaaaaaaaaaaaaaaaaaaaaaa

SEQ ID NO: 689 - protein, 153 aa, Homo sapiens
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 690 - DNA, 1051 bp, Homo sapiens
ggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcaaaaaaaaaaaaaaaaaaa

SEQ ID NO: 691 - protein, 250 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 692 - DNA, 1965 bp, Homo sapiens
aacggcctgacgtcggcggagggaagcaggcgcaggctccgtgaggaggcaagggaactctggcgtaagagctttgtgtgaccagggcagggctggttagaagtgctcagggcccagactcagccaggaatcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 693 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 694 - DNA, 1981 bp, Homo sapiens
aacggcctgacgtcggcggagggaagcaggcgcaggctccgtgaggaggcaagaatccgggctttgcccctgcaatcaacccacggaagctccgggaatggcggccaagcacgcggatcctgacgttcacatatctcagggagttgatgaccttgttttcagaaggtgactcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttcctgttc

SEQ ID NO: 695 - protein, 314 aa, Homo sapiens; identical to SEQ ID NO: 693

SEQ ID NO: 696 - DNA, 1629 bp, Homo sapiens
ggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccagggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctcctacgatggcctgctgggcgacaatcaggtcatgcccaagacaggcctcctgataatcgtcctggccataatcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaaaaaaaaaaaaaa

SEQ ID NO: 697 - protein, 314 aa, Homo sapiens; identical to SEQ ID NO: 693

SEQ ID NO: 698 - DNA, 1975 bp, Homo sapiens
ggagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaaggcaataaaatcctcttaatttccac

SEQ ID NO: 699 - protein, 286 aa, Homo sapiens
MAARVLRARGAAWAGGLLQRAAPCSLLPRLRTWTSSSNRSREDSWLKSLFVRKVDPRKDAHSNLLAKKETSNLYKLQFHNVKPECLEAYNKICQEVLPKIHEDKHYPCTLVGTWNTWYGEQDQAVHLWRYEGGYPALTEVMNKLRENKEFLEFRKARSDMLLSRKNQLLLEFSFWNEPVPRSGPNIYELRSYQLRPGTMIEWGNYWARAIRFRQDGNEAVGGFFSQIGQLYMVHHLWAYRDLQTREDIRNAAWHKHGWEELVYYTVPLIQEMESRIMIPLKTSPLQ

SEQ ID NO: 700 - DNA, 878 bp, Homo sapiens
aacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagcaaaaaaaaa

SEQ ID NO: 701 - protein, 128 aa, Homo sapiens
MESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 702 - DNA, 2576 bp, Homo sapiens
gtcaggggtgacacagaatagctcgctgcgaggatagcaatacacatcaagtctcccttcctttatttctttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaataggttagcaagagagtggacagagaaatacgctatgttgtagggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 703 - protein, 148 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRLAREWTEKYAML

SEQ ID NO: 704 - DNA, 917 bp, Homo sapiens
agaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtccaaaaaaaaaaaaaaaaaaaaaaaaaaaaaaa

SEQ ID NO: 705 - protein, 216 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 706 - DNA, 956 bp, Homo sapiens
agaaagtcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaaccatgatccctagtgaagcccccttgctccaccgccaggtcaaacttgtggatcctatggacaggaaacccactgagatcgagtggagatttactgaagcaggagagcgggtacgagtctccacacgatcagggagaattatccctaaacccgaatttcccagagctgatggcatcgtccctgaaacgtggattgatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtccaaaaaaaaaaaaaaaaaaaaaaaaaaaaa

SEQ ID NO: 707 - protein, 216 aa, Homo sapiens; identical to SEQ ID NO: 705

SEQ ID NO: 708 - DNA, 963 bp, Homo sapiens
ctcagcttgcgccgccgccgccgccgccgccgccgcgcacgccatgggagccgtgactgacgacgaagttatacggaagcgtctcctcattgatggagatggtgctggaggtgatcggagaattaatctgctagtgaagagtttcattaaatggtgcaactctgggtcccaggaggagggatatagccagtaccaacgtatgctgagcacgctgtctcaatgtgaattttcaatgggcaaaactttactagtatatgatatgaatctcagagaaatggaaaattatgaaaaaatttacaaggaaatagaatgtagcatagctggagcacatgaaaaaattgctgagtgcaaaaagcaaattcttcaagcaaaacgaatacgaaaaaatcgccaagaatatgatgctttggcaaaagtgattcagcaccatccagacaggcatgagacattaaaggaactagaggctctgggaaaagaattagagcatctttcacacattaaagaaagtgttgaagataagctggaattgagacggaaacagtttcatgttcttcttagtaccatccatgaacttcagcaaacattggaaaatgatgaaaaactctcagaggtagaagaagctcaggaagcaagcatggaatcagatcctaagccatagacaggctaattgcccaccactcccaggaatattgaaatagctacatgaccataatgtgtttaaaatgtggtatgctcttgagatatttaaagttttggcagtaaaatactctgtttttaagtatgaatgtatttcattcatatttcctctcacaaaggaaaatgacttcagtatagatttgtttttattaaaatgcattttttattcttaagtggtaggaagcaacatccaaaaatgcttaataaaatgcttttaagctgcaaaaaaaaaaaaaaaaaaaaaaaaaaaaaaaaaaaaaaaaaaaa

SEQ ID NO: 709 - protein, 204 aa, Homo sapiens
MGAVTDDEVIRKRLLIDGDGAGGDRRINLLVKSFIKWCNSGSQEEGYSQYQRMLSTLSQCEFSMGKTLLVYDMNLREMENYEKIYKEIECSIAGAHEKIAECKKQILQAKRIRKNRQEYDALAKVIQHHPDRHETLKELEALGKELEHLSHIKESVEDKLELRRKQFHVLLSTIHELQQTLENDEKLSEVEEAQEASMESDPKP

SEQ ID NO: 710 - DNA, 2499 bp, Homo sapiens
ggccggctcctaccctgaaggtgcacctgcagtcctcgccgataagaggcagcagttcggaagccggttcctgagagatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggactggttcttggagaacaagagtgaagtacctgaatgtagaaacaatgaggatggacctggtttaataatggaagaacagcacaagtgttcttcaaagagccttgaacataaaacacagacacttcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcgtggccaacatggtgaaaccccgtctctactaaagataaaaaaattagctgagtgtgttggtgggtgcctgtaatccagctacttgggagactgaggcaggagaattgcttgaacccaggaggcagaggttgcagtgagctgagattgtgccactgcactccagcctgggcaacaaagcaagactctgtctcaaaaaaataaaaataaaaaaaaaatcttagttccatggaattttaagcattgttccccctctaacctgtgtctaaagaattaaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggaggtggaggttgcagtgagccaagatcatgtcactgcattccagcctgggcaacagaggaagactccgtctc

SEQ ID NO: 711 - protein, 242 aa, Homo sapiens
MEEQHKCSSKSLEHKTQTLPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 712 - DNA, 3617 bp, Homo sapiens
acccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttctt

SEQ ID NO: 713 - protein, 300 aa, Homo sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 714 - DNA, 1343 bp, Homo sapiens
agaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtacttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaataatcaagcaagcaggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcgtgattagaaatgtttgttattggaaatgttacaccatgtaaataaaggaaatagattttagtattgtattcattttatattatagaactgcataatgtctgcagaataaaattaaaactaacaaataaaaaaaaaaaaaaaa

SEQ ID NO: 715 - protein, 248 aa, Homo sapiens
MICTFLRAVQYTEKLHRSSAKRLLLPYIVLNKAYLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 716 - DNA, 1535 bp, Homo sapiens
cgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataaaaaaaaaaaa

SEQ ID NO: 717 - protein, 145 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 718 - DNA, 2680 bp, Homo sapiens
cggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttacaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagacgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtgtttacaaatatgtgccattgtgcaacatcggtggattttctaaaaataatgtaaatgtcttctattaaatgttgagtgcaataaaatccagaa

SEQ ID NO: 719 - protein, 313 aa, Homo sapiens
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 720 - DNA, 404 bp, Homo sapiens
gcctgccctgacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaaaaaaaaaaaaaaaaaaaaaaa

SEQ ID NO: 721 - protein, 61 aa, Homo sapiens
MDPNCSCTTGGSCACAGSCKCKECKCTSCKKCCCSCCPVGCAKCAQGCVCKGSSEKCRCCA

SEQ ID NO: 722 - DNA, 548 bp, Homo sapiens
gggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaaaaaaaaaaaaaaa

SEQ ID NO: 723 - protein, 106 aa, Homo sapiens
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 724 - DNA, 2146 bp, Homo sapiens
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctaga

SEQ ID NO: 725 - protein, 232 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATS

SEQ ID NO: 726 - DNA, 3985 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 727 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 728 - DNA, 2187 bp, Homo sapiens
gggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 729 - protein, 147 aa, Homo sapiens
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 730 - DNA, 2151 bp, Homo sapiens
agttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 731 - protein, 147 aa, Homo sapiens; identical to SEQ ID NO: 729

SEQ ID NO: 732 - DNA, 2233 bp, Homo sapiens
ggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 733 - protein, 147 aa, Homo sapiens; identical to SEQ ID NO: 729

SEQ ID NO: 734 - DNA, 2386 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 735 - protein, 147 aa, Homo sapiens; identical to SEQ ID NO: 729

SEQ ID NO: 736 - DNA, 2240 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 737 - protein, 147 aa, Homo sapiens; identical to SEQ ID NO: 729

SEQ ID NO: 738 - DNA, 2359 bp, Homo sapiens
agttccgtcagagcggacatcttgtggctgtgtcgtgcgcgtgagccccgtagggccggggaggcaccagctgccgcgcggggaggaggccgaggccgcagcttgagggaggccccggcccctctaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 739 - protein, 147 aa, Homo sapiens; identical to SEQ ID NO: 729

SEQ ID NO: 740 - DNA, 2594 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcttcctccctcccccgccctcctggtccaatctccgatctgtttagtaagaaggtgctgttccgagaaggagaaggaaaagggcttgacacgtattcactcggccccggacgtgggaagcaagccgtctggcttcggcctcacatcggtcctgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 741 - protein, 147 aa, Homo sapiens; identical to SEQ ID NO: 729

SEQ ID NO: 742 - DNA, 1183 bp, Homo sapiens
gccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttatt

SEQ ID NO: 743 - protein, 198 aa, Homo sapiens
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHESSLGFGYPKFISHQDIRKRNYVRDDAVFIRAAVELPRKILS

SEQ ID NO: 744 - DNA, 2863 bp, Homo sapiens
gtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacagacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattagaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtggaaaaaaaaaaaaaaaaaaaaaaaaaaaaaaaaaaaa

SEQ ID NO: 745 - protein, 307 aa, Homo sapiens
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 746 - DNA, 4026 bp, Homo sapiens
aaaattggaaacatggccgtacggtcgctgtgggcgggccggctgcgggtgcagcgcctactggcctggagtgccgcgtgggagagcaagggatggccgcttccattcagcactgccacccagagaactgctggtgaggactgccgttctgaggaccctcctgatgagcttgggccccctcttgctgaacgagccttaagggtaaaagctgttaaactggagaaagaagtccaagatttaacagtgagataccagagagctatagctgattgtgaaaacataaggaggcgaacccagagatgtgtggaagacgccaagatatttggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtagctaggactacaggcgttcaccactgcgcccgcaaagtttttttgttgttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtattctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccttcttcatcagatttagacccttgaaaaacaagtaaatatgcacttttaaaatgcaatcaaaagactggtggttaagcttgtaaaaccagaacatcttttggcattccactgagtatatattgtaaatttaatgaacaatcaaggttcacaataggaagttgtctttttttgccttccattctgtgagatttgacagatggtgacaataagaaaatgagctgattgtaattactctctgtgggtttttttattgctacgctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgtgttggcaagtaaattcagaataattttaggttcttttgttattcagtagttttgcagacttaaaagtgtaaatttagaattagaagatgaagctatagtagtaagaatctcaagctgaagggctttggggagccaaagcagcatattacagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagtaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgcaaaaaaaaaaaaaaaaaaaaaaaaaaaaaaaaaaaa

SEQ ID NO: 747 - protein, 225 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 748 - DNA, 2233 bp, Homo sapiens
cgctcttcggggcccgggtggtctggaacaatgttgcttggctgggcggctgcgggatagggcggaaggggacaggcttgaggcttggataggcgtgaggaggcgcatacgaccgcacaacccgaggtttgtaactgtattcggaagacgccgggtccggctgggactgccagaggaacctggctttgcaggactacggaggagtaacgtcgagtgaattggaagagggcccagggccgcacaagcagcgtcaccctttacaccagaaagctggcgggcactatggggaaaaaacaaaacaagaagaaagtggaggaggtgctagaagaggaggaagaggaatatgtggtggaaaaagttctcgaccgtcgagtggtaaagggcaaagtggagtacctcctaaagtggaagggattctcagatgaggacaacacatgggagccagaagagaacctggattgccccgacctcattgctgagtttctgcagtcacagaaaacagcacatgagacagataaatcagagggaggcaagcgcaaagctgattctgattctgaagataagggagaggagagcaaaccaaagaagaagaaagaagagtcagaaaagccacgaggctttgctcgaggtttggagccggagcggattattggagctacagactccagtggagagctcatgttcctgatgaaatggaaaaactctgatgaggctgacctggtccctgccaaggaagccaatgtcaagtgcccacaggttgtcatatccttctatgaggaaaggctgacgtggcattcctacccctcggaggatgatgacaaaaaagatgacaagaactaacgctcctgagtaccagcccctgtcacatctgactgtgggtttcaagtgggaagggaaggagttctacttgtcttgacaccatagaggtggcttgagaagatgtcctttgaagagccagtatagtttctgtgccctgcagcagcccaagtgctttaaagccgtttcaagctgtatagtttgcacacccatcccagtggaggggaaaggggataagtgtttcaaggcaaccttttctgcactttgctgcgaaaagcaaagggccttctatgaaggacaaaacttgcagaattgggtgtgtgggagagcaaaaaaatactgtagatcttcaaagagcatctccacaacccacagccttcttcccaatagtgttaactctgcatttttacagcgtagcatgtgtgtagtttttggctattactggtgtattatttgggggagggagggatggggaggggagaaagggagatgggtagcatcattttgattaacatttggggcctgataggggaaatggtgaagcaatggaaaagaacagacaactaatgatttgcttctatgtccagaatattttacctttaaaaaaatgtcattggcaccataaataaggactgtgagagactgtttaaaagctgtgaaagtctgaaacctataagccaaggtgttccctgcctaaacttattgctgttcccacaaaggactaagcctgttcataagttaccaaagttgccattttggagatggaaattgacgaggagggaaggtcttttattggagagtatacagtacaagcagatcattctgccttagaggtgctaattcccgaaattagaagaccctttcttttccagtaatgaagttataaatatcagcttgttcatccaagccactggctgaggtgttaggaagaggaagagggtggtagaggaggtaagacagtagggaaagacaagggcccatgctcttagtggggaaaactcttggagccgtttactttgagctttgaacactgaaaccattgttggcagggttcagtcactgacagcacaagtttcactgaattgatccaagagtttagtgatttcaaaagccttggtctcaggagaagattaaactttcatattgggcagtggttcactttaaaacacacacatacacacacaaaacaattttttaagaaatcctaataagtaacatacccaaaatgctctgtcttgagtcatgagaaccatcagttcttgatattgtctagacttgcatctagagctacgttgtaaaattcttttaggcatgtgttagatttctgtgtaaactttgtttaaatgtaaacttcatactacattgtcagtttttgtcttaataaaactatagatttataaaaaaaaaaaaaaaaaaa

SEQ ID NO: 749 - protein, 185 aa, Homo sapiens
MGKKQNKKKVEEVLEEEEEEYVVEKVLDRRVVKGKVEYLLKWKGFSDEDNTWEPEENLDCPDLIAEFLQSQKTAHETDKSEGGKRKADSDSEDKGEESKPKKKKEESEKPRGFARGLEPERIIGATDSSGELMFLMKWKNSDEADLVPAKEANVKCPQVVISFYEERLTWHSYPSEDDDKKDDKN

SEQ ID NO: 750 - DNA, 541 bp, Homo sapiens
cttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaaca

SEQ ID NO: 751 - protein, 156 aa, Homo sapiens
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKISRLRRECPSDECGAGVFMASHFDRHYCGKCCLTYCFNKPEDK

SEQ ID NO: 752 - DNA, 1099 bp, Homo sapiens
agccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgcccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccccttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctccca

SEQ ID NO: 753 - protein, 104 aa, Homo sapiens
MWVPVVFLTLSVTWIGERGHGWGDAGEGASPDCQAEALSPPTQHPSPDRELGSFLSLPAPLQAHTPSPSILQQSSLPHQVPAPSHLPQNFLPIAQPAPCSQLLY

SEQ ID NO: 754 - DNA, 1540 bp, Homo sapiens
cggccgcgagtcctgcgtgatcgcgagcatgtgtgcgtgcgcgtgtttatctgaggcgcgtgcggcggccaccccagcctagtcctcttcttggtgccactggctaactaggttgagaaaccggcgccacaggcggcacacctggcccggagctggcccgctcctccccgccgagccggcgccccaacaacgcgccctctcccagtcctcacaaaggggcctagtccggcccccggctctggccgtgagggagcgctgtgggggcgcgctgccttctgcctggaagtgttgggcaggtggtgggagagcgtcaggcttgaacaacatgattttaaagcacgtgtctgtctgtcgttttttacttttagggttttggccaaattgggcgagggcacaaaataaccacttaccccttctcaccgaggaagagcgggagaaagggtatggcacagtcacaagggtgggtgaaaagatacatcaaggccttttgtaaaggcttctttgtggcggtgcctgtggcagtgactttcttggatcgggtcgcctgtgtggcaagagtagaaggagcatcgatgcagccttctttgaatcctggggggagccagtcatctgatgtggtgcttttgaaccactggaaagtgaggaattttgaagtacaccgtggtgacattgtatcattggtgtctcctaaaaacccagaacagaagatcattaagagagtgattgctcttgaaggagatattgtcagaaccataggacacaaaaaccggtatgtcaaagtcccccgtggtcacatctgggttgaaggtgatcatcatggacacagttttgacagtaattcttttgggccggtttccctaggacttctgcatgcccatgccacacatatcctgtggcccccagagcgctggcagaaattggaatctgttcttcctccagagcgcttaccagtacagagagaagaggaatgactgcatgaatctacctgagttgctggcattgggaggccagttactggaaaggaatggaaaaaagaagcctccaaaagggaaaaacttctgacaatatgatgctgtgcgagaaatatttacagcacattaaaacgatctgtattattaaataaataattttcaaatgttaaacagtattaaatggcacctgattttgtgttaaattttagttccctgttgtttaatgcccccaaaatatgcagacctttgggaatataaaaatattgcacccacatgtcttaatggggctgaatttcagattatttgttacatatacttattatattgattgttgggttttgattttggtgcttgctgctgaaataaattgaaaattaatattcaataaaaatgatgtatttgtcacttgctgttaaggtagaacaagaaggaacacatattatacacataatgatgggaattacattgtgatttgtactatctacaaaggagtaactgccagttaggaagaacagtaaacagtgatgttaaaataaaacaatgatttgtaaaaaaaaaaaaaaaaaaaa

SEQ ID NO: 755 - protein, 175 aa, Homo sapiens
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 756 - DNA, 717 bp, Homo sapiens
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcat

SEQ ID NO: 757 - protein, 202 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDIGQAKRSFLRLAKISFDVLIKKALA

SEQ ID NO: 758 - DNA, 1236 bp, Homo sapiens
gctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcagaaaaaaaaaaaaaaaaaaaaaaaaaaaaaa

SEQ ID NO: 759 - protein, 208 aa, Homo sapiens
MASKCPKCDKTVYFAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 760 - DNA, 2006 bp, Homo sapiens
ggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggaaaaaaaaaaaaaaaa

SEQ ID NO: 761 - protein, 149 aa, Homo sapiens
MLSNRKCLSKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 762 - DNA, 946 bp, Homo sapiens
cggcgcgtgtcacgtggtgtgcgtgtcgaaggtcacggcgcgctcacaatggagctctcggagtctgtgcagaaaggcttccagatgctggcggatccccgctccttcgactccaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaga

SEQ ID NO: 763 - protein, 195 aa, Homo sapiens
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 764 - DNA, 1108 bp, Homo sapiens
cacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcaaaaaaaaaaaaaaaaaaaaaaaaaaaaaaa

SEQ ID NO: 765 - protein, 89 aa, Homo sapiens
MAAQIPESDQIKQFKEFLGTYNKLTETCFLDCVKDFTTREVKPEETTCSEHCLQKYLKMTQRISMRFQEYHIQQNEALAAKAGLLGQPR

SEQ ID NO: 766 - DNA, 1053 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccaccaaaaaaaaaaaaaaaaaaaaaa

SEQ ID NO: 767 - protein, 161 aa, Homo sapiens
MQAVRNAGSRFLRSWTWPQTAGRVVARTPAGTICTGARQLQDAAAKQKVEQNAAPSHTKFSTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 768 - DNA, 1799 bp, Homo sapiens
acactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaaa

SEQ ID NO: 769 - protein, 152 aa, Homo sapiens
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 770 - DNA, 921 bp, Homo sapiens
cagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaaaaaaaaaaaaaaaaaaa

SEQ ID NO: 771 - protein, 203 aa, Homo sapiens
  VARIANT 49: Xaa - selenocysteine
MCAARLAAAAAAAQSVYAFSARPLAGGEPVSLGSLRGKVLLIENVASLXGTTVRDYTQMNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAWNFEKFLVGPDGVPLRRYSRRFQTIDIEPDIEALLSQGPSCA

SEQ ID NO: 772 - DNA, 1204 bp, Homo sapiens
cggaacgagggcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaagcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggacgactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggagccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaa

SEQ ID NO: 773 - protein, 308 aa, Homo sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDDCPLGPGRCCRLHTVRASLEDLGWADWVLSPREVQVTMCIGACPSQFRAANMHAQIKTSLHRLKPDTEPAPCCVPASYNPMVLIQKTDTGVSLQTYDDLLAKDCHCI

SEQ ID NO: 774 - DNA, 691 bp, Homo sapiens
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 775 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 776 - DNA, 1231 bp, Homo sapiens
gacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaaaaaaaa

SEQ ID NO: 777 - protein, 357 aa, Homo sapiens
MATPAVPVSAPPATPTPVPAAAPASVPAPTPAPAAAPVPAAAPASSSDPAAAAAATAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 778 - DNA, 1125 bp, Homo sapiens
cccccatgtgacagtgacggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattaaaaaaaaaaaaaaaaaa

SEQ ID NO: 779 - protein, 220 aa, Homo sapiens
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 780 - DNA, 2472 bp, Homo sapiens
ttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcactgaccagctgaccagctgaccaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacaaaaaaaaaaaaaaaaaaaaaaaaaaaaaaaaaaaaa

SEQ ID NO: 781 - protein, 94 aa, Homo sapiens
MASVVLALRTRTAVTSLLSPTPATALAVRYASKKSGGSSKNLGGKSSGRRQGIKKMEGHYVHAGNIIATQRHFRWHPGAHVSCSVAAPLFPFLG

SEQ ID NO: 782 - DNA, 624 bp, Homo sapiens
gggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccgacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaaaaaaaaaaaaaaa

SEQ ID NO: 783 - protein, 71 aa, Homo sapiens
MAVTALAARTWLGVWGVRTMQARGFGSDQSENVDRGAGSIREAGGAFGKREQAEEERYFRHYRLCFEISLG

SEQ ID NO: 784 - DNA, 1161 bp, Homo sapiens
cagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaa

SEQ ID NO: 785 - protein, 173 aa, Homo sapiens
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 786 - DNA, 454 bp, Homo sapiens
tctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaaaaaaaaaaaaaaaaaaaaaaaaaaaaaaaaaaa

SEQ ID NO: 787 - protein, 61 aa, Homo sapiens
MDPNCSCSPVGSCACAGSCKCKECKCTSCKKSCCSCCPVGCAKCAQGCICKGTSDKCSCCA

SEQ ID NO: 788 - DNA, 2126 bp, Homo sapiens
gcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggtaaaaaaaaaaaaaaaaaaa

SEQ ID NO: 789 - protein, 184 aa, Homo sapiens
MREYKLVVLGSGGVGKSALTVQFVQGIFVEKYDPTIEDSYRKQVEVDAQQCMLEILDTAGTEQFTAMRDLYMKNGQGFALVYSITAQSTFNDLQDLREQILRVKDTDDVPMILVGNKCDLEDERVVGKEQGQNLARQWNNCAFLESSAKSKINVNEIFYDLVRQINRKTPVPGKARKKSSCQLL

SEQ ID NO: 790 - DNA, 3669 bp, Homo sapiens
cgcagcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcgcggccccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaa

SEQ ID NO: 791 - protein, 220 aa, Homo sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 792 - DNA, 1163 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 793 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 794 - DNA, 1402 bp, Homo sapiens
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggcttctgaattcccttctgagttaatgtcaaatgacagcaaagcactgtgtggctgaataagcggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtcaaaaaaaaaaaaaaaaaaaaaaaaaaaaaaaaaaaaaaaa

SEQ ID NO: 795 - protein, 134 aa, Homo sapiens
MKAFSPVRSVRKNSLSDHSLGISRSKTPVDDPMSLLYNMNDCYSKLKELVPSIPQNKKVSKMEILQHVIDYILDLQIALDSHPTIVSLHHQRPGQNQASRTPLTTLNTDISILSLQASEFPSELMSNDSKALCG

SEQ ID NO: 796 - DNA, 1545 bp, Homo sapiens
gaaacccagctgcagaggctgcagccccggtccccagcggctaaaggacccccgagctcggggagggggaggccgctccggcccagcgctctgcgccctccggctccccctccccctcctccctgctccttcgctctgcaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttttgcggaggcagatccgcacggtaattcagtaccaaactgttcgatatgatatcctccccttatctcctgtgtcccggaatcggctagcccaggtgaagaggaagatcctggtgctggatctggatgagacacttattcactcccaccatgatggggtcctgaggcccacagtccggcctggtacgcctcctgacttcatcctcaaggtggtaatagacaaacatcctgtccggttttttgtacataagaggccccatgtggatttcttcctggaagtggtgagccagtggtacgagctggtggtgtttacagcaagcatggagatctatggctctgctgtggcagataaactggacaatagcagaagcattcttaagaggagatattacagacagcactgcactttggagttgggcagctacatcaaggacctctctgtggtccacagtgacctctccagcattgtgatcctggataactccccaggggcttacaggagccatccagacaatgccatccccatcaaatcctggttcagtgaccccagcgacacagcccttctcaacctgctcccaatgctggatgccctcaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcaaaaaaaaaaaaaaaaaaa

SEQ ID NO: 797 - protein, 244 aa, Homo sapiens
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 798 - DNA, 1236 bp, Homo sapiens
acttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctacgaggtagaggggtgggggttggtgggctgtcacggagcgactgtcgagatcgcctagtatgttctgtgaacacaaataaaattgatttactgtctgc

SEQ ID NO: 799 - protein, 156 aa, Homo sapiens
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 800 - DNA, 3747 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 801 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQTCNASFATRDRLRSHLACHEDKVPCQVCGKYLRAAYMADHLKKHSEGPSNFCSICNRGLQAPGAHPEWGSSVPLRQDLWQQRRPEMLTSGSD

SEQ ID NO: 802 - DNA, 4229 bp, Homo sapiens
ggcggcggcgggcgcgggaagatggcggcagcggcggcggcggctgcagaacagcaaagttccaatggtcctgtaaagaagtccatgcgtgagaaggctgttgagagaaggagtgtcaataaagagcacaacagtaactttaaagctggatacattccgattgatgaagatcgtctccacaaaacagggttgagaggaagaaagggcaatttagccatctgtgtgattatcctcttgtttatcctggctgtcatcaatttaataataacacttgttatttgggccgtgattcgcattggaccaaatggctgtgatagtatggagtttcatgaaagtggcctgcttcgatttaagcaagtatctgacatgggagtgatccaccctctttataaaagcacagtaggaggaaggcgaaatgaaaatttggtcatcactggcaacaaccagcctattgtttttcagcaagggacaacaaagctcagtgtagaaaacaacaaaacttctattacaagtgacatcggcatgcagttttttgacccgaggactcaaaatatcttattcagcacagactatgaaactcatgagtttcatttgccaagtggagtgaaaagtttgaatgttcaaaaggcatctactgaaaggattaccagcaatgctaccagtgatttaaatataaaagttgatgggcgtgctattgtgcgtggaaatgaaggtgtattcattatgggcaaaaccattgaatttcacatgggtggtaatatggagttaaaggcggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgttctctaaaataattatgagaagcaaataaaatcaaaagtcatgtttaaagacgtgtttttaaaattccactatcccttttctaaaggttaaaggtctgaagcagctgtttagattcactgtaagtaaactttggtaactctaatggggatagacccacttaagatatttaaaaaggtatggcatcagcgtttcatgctctgccttttagcttctaaaaggaaagatgcagatttctagtgcattaagcctgagccatattctcacatgcaagtgaagtcattaaagaactttacatatgtgagatagaaacaatggttccttagttttgcactgggaagaaaatattttgtaaaagaatgtttatttgaaataatgataactatcaattgttcacaatgtggtggaaattaaaacaccatctcagctttaacttttaaataataatgataactatctttattgagcatcttctacatcctaggcattgtcctaggcattgcatgtttatatccccaattctcaccacaaccctgcaagtaggtggtattatccaagttttacccattaagaaactgaagatcagagaagttaagaaacttgctcaacatcatatagtaagtagcagagttgggattggaattcaggcatgactcaaacctggatgtacttgattccaaatgccatgttgttttcactctctgcactgactttttaattatttaaaactctagaaagatgaacaaaggttaatttaaacttacctaagaagatgagaatcaaacaaaacagatatgcttactctagttaaaaagaaaataaatctcatgtcagacccagaaaggaccaatcactgtccgattgtaagctatgttgggccaattccaaaatattatacgatggagaggtcaaatttacctacttctgagttacctcagtttcccaacaatggaccttggcacactggagtaacaatacataacagagttgccaagatatttataccctcagcactcggggcaacacagtggaaagtggggaggccatagacccaaacaagttctttgggccaggcatggcctagtaagtacaccatgcctcgaaaataagtccagaagcactggactaaagagtgctaatgcaggaaataatacacataatttttaggtaaggataataatttatctctgctcctaatattactatcccattgtaattatttataaccctcaagccagttgatttttaatatatttgattggaaaagaactctctggtattattaagactcacacagaatcagggacagggcccccaaaggagtttgctgtaaaataggcagtagagttgtggcatgggcccaaccctgcattcaagtgtaacagcattctgtcagggtcactttgaattgtgcacataagaaaaccaatacaaaaaacaatttgtattcaatattgtcacatttctctctggtagaaaaatcaaataccttagagattatgaagtcattaatttatactgaaattggattgacttactacctaacactgagcgctgtttttaaatgaaaagaatgagatttataaccacttgagtgttattgcagtgatatttgaactcatttgaatatattcagtatcatttaatgtctgaattcagaaaaaaatgccgaaatttttattcagatggtccataaattaaattgcatattcattacttatctgctctatttagatttattttaaaagtttatttaagtaaatatttttataaaaaccagaaaacactgtattacaaaatattatttattaaatgtagttcaggaaataatctatttttactcttttttgggaaatacttgtgtttttgatacatctccatgaagttcttttgagaggagaggctattttgatgtttttatacaactgaaggttaacagccatagcattttatgatactttacaggtagtcctggctttttccctgaaacataagcttggaaaatctattagaaagcagaacagggcaaactctccattttacttatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcccgagtacctgggactacaggcatgtgccacagttcccggctaatttttgtatttttagtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggaggtgggtgacaaagataggaccccgggagggggcgcaggtacatgctagtttcaattaccacagtattctagagacgggttgcaatgacaaggggggcaaatgaaatcaatgcaagatttcttaataatgggcagacagaaaaatgtaaaaccacacaaaacggactgctgataatattttaaaatatacttatttgtcttctttttgcattgtgaaaaaaacaaaataaattttgtgtgataattttgatgatgaaaggtggaagttctacctagatttgaatgagtgtttttttaagggaatgagaatgtcatggtgctaaacctgacaaataagagatcattgaaatgctgaaaattttaacagtcttcttaaaagtattgagggggcaaaaattaccaattatggtatacaaaaataagcctataaatgtgtttcacattgctaacttgagtttcagttgattcagtttgtaataactagtaatgagcttctgtttacaataaaaattctgtaaattg

SEQ ID NO: 803 - protein, 318 aa, Homo sapiens
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 804 - DNA, 4402 bp, Homo sapiens
agtggcgcggccggctgggtggcccgcgagctgcacccggatctgctcggcggcggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgtgagtgacagttcatttagattctttgtattcttcttcgtctatatttgtcagtttgctgtacatgtactccaagctgcaggatttcataactggggcattggtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaaaaaaaaaaaaaaaa

SEQ ID NO: 805 - protein, 157 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWM

SEQ ID NO: 806 - DNA, 1437 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagaaggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaaaccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 807 - protein, 116 aa, Homo sapiens
MEPAAGSSMEPSADWLATAAARGRVEEVRALLEAGALPNAPNSYGRRPIQVGRRSAAGAGDGGRLWRTKFAGELESGSASILRKKGRLPGEFSEGVCNHRPPPGDALGAWETKEEE

SEQ ID NO: 808 - DNA, 1275 bp, Homo sapiens
gcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacgaagacgagatgtcacagaggtccactcagtgacaaacacacactgaaggcctgagggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaaaa

SEQ ID NO: 809 - protein, 150 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYEQAQAICKVLSTAFDSVLTSEKP

SEQ ID NO: 810 - DNA, 2279 bp, Homo sapiens
aggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgaaaaaaaaaaaaaaaaaaaaaa

SEQ ID NO: 811 - protein, 81 aa, Homo sapiens
MGQLCCFPFSRDEGKISEKNGGEPDDAELVRLSKRLVENAVLKAVQQYLEETQNKNKPGEGSSVKTEAADQNGNDNENNRK

SEQ ID NO: 812 - DNA, 788 bp, Homo sapiens
atgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctg

SEQ ID NO: 813 - protein, 185 aa, Homo sapiens
MPRLFFFHLLGVCLLLNQFSRAVADSWMEEVIKLCGRELVRAQIAICGMSTWSKRSLSQEDAPQTPRPVAEIVPSFINKDTETINMMSEFVANLPQELKLTLSEMQPALPQLQQHVPVLKDSSLLFEEFKKLIRNRQSEAADSSPSELKYLGLDTHSRKKRQLYSALANKCCHVGCTKRSLARFC

SEQ ID NO: 814 - DNA, 2012 bp, Homo sapiens
gattcttctatttggccactctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagaaaaaaaaaaaaaaaaaaaa

SEQ ID NO: 815 - protein, 183 aa, Homo sapiens
MQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 816 - DNA, 3206 bp, Homo sapiens
gtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacagttctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacgttgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttgaaaatatgacattttatgtagcactatataaaaagtgaaagcgacaaattccaccgctgcttaatactgctttgcttctttttattgacatgatagatacatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcatttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctagatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 817 - protein, 329 aa, Homo sapiens
MSGVVPTAPEQPAGEMENQTKPPDPRPDAPPEYSSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYVVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 818 - DNA, 4947 bp, Homo sapiens
agcggagtaggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgtgccgaccgccggcgccgcacccccggagctggccttcggcaagggccgccccgagcagctgggctcgcccctgcactccagctatctcaacagcttcttccagctgcagcgcggagaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcggaaatccctctttcctgagtcagcaatcgtggcaaggggacatgtgttccaacagcggctggggagtggacctctctgtcccttgcccaccttaagccccaaatccggaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttctagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaagcctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcagcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggccttttttttaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagcaaaaaaaaaaaaaaaa

SEQ ID NO: 819 - protein, 241 aa, Homo sapiens
MSLLSAIDTSAASVYQPAQLLNWVYLSLQDTHQASAFDAFRPVPTAGAAPPELAFGKGRPEQLGSPLHSSYLNSFFQLQRGEALSNSVYKGASPYGSLNNIADGLSSLTEHFSDLTLTSEARKPSKRPPPNYLCHLCFNKGHYIKDCPQARPKGEGLTPYQGKKRCFGEYKCPKCKRKWMSGNSWANMGQECIKCHINVYPHKQRPLEKPDGLDVSDQSKEHPQHLCEKCKVLGYYCRRVQ

SEQ ID NO: 820 - DNA, 3770 bp, Homo sapiens
caagccgccggcccggagagcgcgcggcggcggcggcggcgggacggccccgagcgcgccctccccgtgcggccactcgcagcggcgctggccgggccggcgcgcccgcaggcggctagagcagcggcctcggcctcggcgcgggcttgccccgggccgtagcccgcgagaggcggcgcgggcggccgagggcactgaacggcgtcgcggtacgctcccgggcggcggcgcagcggcagcggcagcggcagcggcagcgcagggggcggaggcagggggcgcccccagccaggatgctgcggttcctgcgccggacctttggccgccgctccatgcagcgctacgcggggcgcggcggggcgcggggccgccgggctgggggacgagcgcgatgggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccggaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggcttggactaagtgatctccaaggtcctttccaactctaaaattctgcaatttgttaacatttcattttgtttaggttgaggacatacattcaaactaattttatcacaaggaaaacgtcaatacccacttccttgacagagttactctttcagaagctaaataaagtatataacttattagatgttatatagatacagggggactttgaatttcacatcttaaagcagttgagctactttgaatttaagcagtcgtactaatcttaaattgcatagcatttgttttgatcgaatttactgctcaagtatggaataatttttaatgtcttaatgattggtgctgctaacttgcgtgatttcagaagactgtacgaattgggggattggtttttaccctagacttcactcttaaaaagcaagctgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaaaaaaaaaaaaa

SEQ ID NO: 821 - protein, 504 aa, Homo sapiens
MQRYAGRGGARGRRAGGRARWGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 822 - DNA, 1075 bp, Homo sapiens
ggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgca

SEQ ID NO: 823 - protein, 102 aa, Homo sapiens
MFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 824 - DNA, 1896 bp, Homo sapiens
cccacgcgtccgcggacgcgtgggcgcgcgggagctgggaggctgcgagatccctaccgcagtagccgcctctgccgccgcggacttcccgaacctcttcagccgcccggagccgctcccggagcccggccgtagaggctgcaatcgcagcgggagcccgcagcccgcgccccgagcccgccgccgcccttcgagggcgcccaggccgcgccatggtgaaggtgacgttcaactccgctctggcccagaaggaggccaagaaggacgagcccaagagcggcgaggaggcgctcatcatcccccccgacgccgtcgcggtggactgcaaggacccagatgatgtggtaccagttggccaaagaagagcctggtgttggtgcatgtgctttggactagcatttatgcttgcaggtgttattctaggaggagcatacttgtacaaatattttgcacttcaaccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaagggaccacagtgacttatttgtagttgttagttgcccctgctaccctagtttgttaggtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaaaaaaaaaaaaaa

SEQ ID NO: 825 - protein, 266 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 826 - DNA, 2077 bp, Homo sapiens
ccgagcgccagcgcggggaaccgggaaaaggaaaccgtgttgtgtacgtaagattcaggaaacgaaaccaggagccgcgggtgttggcgcaaaggttactcccagacccttttccggctgacttctgagaaggttgcgcacagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 827 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 828 - DNA, 2629 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggtaggggcccacttcaccgtactaaccagggaagctgtccctcatgttgaattttctctaacttcaaggcccatatctgtgaaatgctggcatttgcacctacctcacagagtgcattgtgagggttaatgaaataatgtacatctggccttgaaaccaccttttattacatggggtctaaaacttgacccccttgagggtgcctgttccctctccctctccctgttggctggtgggttggtagtttctacagttgggcagctggttaggtagagggagttgtcaagtcttgctggcccagccaaaccctgtctgacaacctcttggtcgaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtggagctggaagggtcaacatcttttacattctgcaagcacatctgcattttcaccccacccttcccctccttctccctttttatatcccatttttatatcgatctcttattttacaataaaactttgctgcca

SEQ ID NO: 829 - protein, 393 aa, Homo sapiens [sequence omitted]

SEQ ID NO: 830 - DNA, 5074 bp, Homo sapiens
ggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctcctttccatggagatagagaaagaaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaaaaaaaaaaaaaaaa

SEQ ID NO: 831 - protein, 259 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWR

SEQ ID NO: 832 - DNA, 1281 bp, Homo sapiens
ccggcggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcaaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtgggggccactgatcttcctggacaggagtggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaaaaaaaaaaaaaaaaaaa

SEQ ID NO: 833 - protein, 115 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNM

SEQ ID NO: 834 - DNA, 403 bp, Homo sapiens
gtccttcctctcctagcctaaggcgtgcaaacagagcgccactgggaggctgaaacctttaggccgatgcttgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacgctgtctctatttatacaataaaatttttttaaaaaaggaaaaaaaaaaaaaaaaaaaaaa

SEQ ID NO: 835 - protein, 57 aa, Homo sapiens
MLCAHFSDQGPAHLTTSKSAFLSNKKTSTLKHLLGETRSDGSACNSGISGGRGRKIP

SEQ ID NO: 836 - DNA, 771 bp, Homo sapiens
aaagcgttctcggcggcagcgcaacaactagaaccgtgagaacgcgtccagcaaccgcgaccacgacgacgtcacctcgggcacgcccaaggagaagaaagcccagacctctaagaagaagcagagctccatggccaaggcgtagcggcaggcgtcccccgcagacctccccatcgaccccagcgagccctcctactgggagatgatccgctgcgacaacgaatgccccatcgagtggttccgcttctcgtgtgtgagtctcaaccataaaccaaagcgcaagtggtactgttccagatgccggggaaagaacgatgggcaaagcccttgagaagtccagaaaaaaaacagggcttataacaggtagtttggggacatgcgtctaatagtgaggagaacaaaataagccagtgtgttgattacattgccacctttgctgaggtgcaggaagtgtaaaatgtatatttttaaagaatgttgttagaggccgggcgcggtggctcacgcctgtaatcccagcactttgggaggccgaggcggtcggatcacgaggtcaggagatcgagaccatcctggctaacacggtgaaaccccgtctctactaaaaattcaaaaaaaaaattagctgggcgtggtggcgggcgcctgtagtcccagctattcgggaggctgaggcaggagaatggcatgaacctgggaggtggagcttgcagtgagccaaggtcgcgccactgcactccagcctgggcgacagagcgagactccatctca

SEQ ID NO: 837 - protein, 42 aa, Homo sapiens
MIRCDNECPIEWFRFSCVSLNHKPKRKWYCSRCRGKNDGQSP

SEQ ID NO: 838 - DNA, 818 bp, Homo sapiens
ccacgcgtccggcggggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaatataataatttaaataaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 839 - protein, 79 aa, Homo sapiens
MHPDLSPHLHTEECNVLINLLKECHKNHNILKFFGYCNDVDRELRKCLKNEYVENRTKSREHGIAMRKKLFNPPEESEK

SEQ ID NO: 840 - DNA, 2824 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 841 - protein, 396 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 842 - DNA, 519 bp, Homo sapiens
acagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctagtccagatctgaacgatgccgtgtccagtttgcgaagtcctattcccctcctcctgtcgcgtgcctttgttcaggtggggatgtatttcatgtagaaggtggaagaaggctgctatgactctttggatgggagtctggcaagaggaaattggaagataaaataaataataagtgaaataaagaaaaaaaaaaaaa

SEQ ID NO: 843 - protein, 131 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPSPDLNDAVSSLRSPIPLLLSRAFVQVGMYFM

SEQ ID NO: 844 - DNA, 765 bp, Homo sapiens
ccacgcgtccgggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaagatggcccgaggcagcgccctccttctcgcctccctcctcctcgccgcggccctttctgcctctgcggggctctggtcgccggccaaggaaaaacgaggctggaccctgaacagcgcgggctacctgctgggcccacatgccgttggcaaccacaggtcattcagcgacaagaatggcctcaccagcaagcgggagctgcggcccgaagatgacatgaaaccaggaagctttgacaggtccatacctgaaaacaatatcatgcgcacaatcattgagtttctgtctttcttgcatctcaaagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaattaaaaaaaaaaaaacaaaaaaaaaaaaaaaa

SEQ ID NO: 845 - protein, 123 aa, Homo sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 846 - DNA, 1989 bp, Homo sapiens
cgcctgcaggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagcgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacactgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccagaaaaaaaaaaaaaaaaaa

SEQ ID NO: 847 - protein, 162 aa, Homo sapiens
MGHKARLPAGTRVFHTSCVVGSLTPFRLGGGKADPPSACRAHLAQASPPRGCCSHFCPFPRPGPRSLRPYHKVRSFFHTVSWAWQSLHLVASIPSGPFERISWSSLSELPGLRALGRSLRSWRSAGGRVALSWLSECRARGDGTGALLLGLVVPAAGKGQLV

SEQ ID NO: 848 - DNA, 961 bp, Homo sapiens
cgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaa

SEQ ID NO: 849 - protein, 143 aa, Homo sapiens
MSGGRRKEEPPQPQLANGALKVSVWSKVLRSDAAWEDKDEFLDVIYWFRQIIAVVLGVIWGVLPLRGFLGIAGSFGSSFTLPSIMTDGVQLPSAPYPVQRTLLITAQELDRWGTPAPWNLEDPCFLDRESVCWASVFSARVVT

SEQ ID NO: 850 - DNA, 2212 bp, Homo sapiens
ttttcgcccgctgctgccgccgccgccgccggccgcggctgcactcccaagatggcggctcctccgggcgagtacttcagcgttgggagccaggtgtcgtgccggacgtgccaggagcagcggctgcagggcgaggtggtagcctttgactaccaatccaaaatgctggctttaaaatgtccctcttccagtggaaagcccaaccatgcagacatcttgctcataaacttacagtatgtttcagaagtggaaataattaatgaccgaacagaaacccctcctcccctagcttcactcaatgttagtaagcttgccagcaaagcacggacagagaaggaggagaagctgagccaggcctatgcaatcagtgctggtgtctctctagagggccagcagctcttccagaccattcacaagaccattaaagactgtaaatggcaagaaaaaaacatcgtagtcatggaagaagttgttattacacccccatatcaagtggaaaactgtaaaggcaaagaggggagtgcactgagccatgtacgcaaaatagttgaaaaacattttagagacgtggaaagccaaaagatactgcaacgttcacaagcccagcaaccacagaaggaggccgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcccgccattctgtttttataagtggctacacttgccttctgaatgattgaaagaaacttttacatcttttcttccaaaataaaagtaacaagctgactgtgattcttaaattgagaccagagcagcaaacgtctcactttaaatttttgttttcttttcctttttttttcttttttcttttttttttttttttttgcacagggcatggcttgaattagttttatttttcttaactttaaatatatatatgaaaatatatattaaaatgttctctaaatattttctgcttcttgcaggtctctttttactagatcatggctgttcttcccacctcatccctctgaaaataaaaatgtattgccctccccaccatccatcatagccaggccactaacttgacttggtgcaagagattcttgctgcgaactttgtagagccagtgtgcagatagaatttggctttgagggttcctgatggctttttagtctttaactgtgtgtgtaccagtctcacatttggcccaaacctcaggattctccctctgcctgtcttacttcatggtactagaagaccttcctcgccactctctccacatgagagagtcagctgccctttctcctgtgcctctgcaggaagaactctcttgcatggcacatctcagctcctcattgagggatagttttctttgataagaaacctggagtccatttactctgacctctctttaaatctatatccagagccactagcccaggaaaaacttgggtgacccgtaatttctcttctcctgctgtccttttgctcttacgccccaccccaactccccttaaattttacaggcttatgacagtttgtatgtgctcagccaatgagcagaaaacctggaaagaatttctggactttagcccaccagtttgtctggttgactaacctgctgagagctaaaattggcacccattgccccgtgccttcaggcagtctcctggggcagagtatgccaccatccgaatatcaggcactgagtgggatgtgggtgatgctcacatgactggctagagctttgggggtggggtgggggttaactactatttttttggccatgatctctttccccttcctttttttttttaattaaataaatggatcaaattaaataattcaagccctgccttcaaaatgaaatttttttttagtattatttagcaaaaacaataaaacccaaatttttttaaccatc

SEQ ID NO: 851 - protein, 195 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVEKHFRDVESQKILQRSQAQQPQKEAALSS

SEQ ID NO: 852 - DNA, 540 bp, Homo sapiens
gtccgcgtcgctagctagtcgttctgaagcggcggccagagaagagtcaagggcacgagcatcgggtagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctaaaaaaaaaaaaaaaaaaaaaaaaaaaaaa

SEQ ID NO: 853 - protein, 106 aa, Homo sapiens
MPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 854 - DNA, 746 bp, Homo sapiens
ccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggatcttgtactaacttatgatagaatgtatcagaataaatgtttttaacagtgttatgcttgagtcttttttgaattgaacatgctaggattatcaggtaaaaattaagccttttggtactttctcaaaacagggaatttatgtgtatacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaagaaaaaaaaaaaaaaaaaaaa

SEQ ID NO: 855 - protein, 55 aa, Homo sapiens
MVKLSKEAKQRLQQLFKGSQFAIRWGFIPLVIYLGFKRGADPGMPEPTVLSLLWG

SEQ ID NO: 856 - DNA, 3750 bp, Homo sapiens
ggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatgaaaaaaaaaaaaaaa

SEQ ID NO: 857 - protein, 150 aa, Homo sapiens
MSKISQQNSTPGVNGISVIHTQAHASGLQQVPQLVPAGPGGGGKAVAPSKQSKKSSPMDRNSDEYRQRRERNNMAVKKSRLKSKQKAQDTLQRVNQLKEENERLEAKIKLLTKELSVLKDLFLEHAHNLADNVQSISTENTTADGDNAGQ

SEQ ID NO: 858 - DNA, 1664 bp, Homo sapiens
gcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagctcactctgaattggttggatactggagtgtagaatttggaggcagaatgaatacagtgtttcatatttggaagtatgataattttgctcatcgaactgaagttcggaaagccttggccaaagataaggaatggcaagaacaattcctcattccaaatttggctctcattgataaacaagagagtgagattacttatctggtaccatggtgcaaattagaaaaacctccaaaagaaggagtctatgaactggccacttttcagatgaaacctggtgggccagctctgtggggtgatgcatttaaaagggcagttcatgctcatgtcaatctaggctacacaaaactagttggagtgttccacacagagtacggagcactcaacagagttcatgttctttggtggaatgagagtgcagatagtcgtgcagctgggagacataagtcccatgaggatcccagagttgtggcagctgttcgggaaagtgtcaactacctagtatctcagcagaatatgcttctgattcctacatcgttttcaccactgaaatagttttctactgaaatacaaaacatttcattaactgctataggatctgtctgctaatggtgcttaaattctcccaagaggttctcacttttatttgaaggaggtgttaagttaatttgctatgtttcttgcattatgaaggctacatctgtgctttgtaagtaccacttcaaaaaatagttctgtttactttctgcatggtatttcagtgtctgtcatacattaaaaatacttgtcactgttttaagatcttgactcttcatttgtttcagaatagctcttctactgtattctgacaactctttgctttatagcattttgttgtattcaaatgataatggtagcatttccatgcttgtgacagcatttttaagttattaatatattttatcaacctttccatcatgtctgttttcctggttttttttggttgttttttgaccagtaaaatttattttgtaataccaaataggatttaagaaaattaacgtatttctttactatggaaaaccacattgtcatttgtgacatcatctatattaaatatggttttcacattagttatttgtcacttacttggaaaatgatgctgttaggtcctggtattaaaaatctagaaaagacttgttggtttatgtgctgaaatgtctttatttataattaattttaactactatttacttcatttcggatcctgtttaacaaagatacttgagacatccatttgttttaatgaaatctgtatggatatggaaatgcttgccctaataaaagcctacatatacctccaaaaaaaaaaaaaaaaaaaaaaaaaaaaa

SEQ ID NO: 859 - protein, 247 aa, Homo sapiens
MLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 860 - DNA, 2686 bp, Homo sapiens
gggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaaaaaa

SEQ ID NO: 861 - protein, 164 aa, Homo sapiens
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAGIHPQISSIFVLGSLVYFSQEASRWGT

SEQ ID NO: 862 - DNA, 1120 bp, Homo sapiens
gccgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaacacatgaaaatggactgttagatgccaaaaaaaaaaaaa

SEQ ID NO: 863 - protein, 288 aa, Homo sapiens
MSRLRALLGLGLLVAGSRLPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 864 - DNA, 2264 bp, Homo sapiens
ccgccctggaggccggagccactgggcctgcgcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttgccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggcgctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttgcttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgcagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaaa

SEQ ID NO: 865 - protein, 407 aa, Homo sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTEAPRMRSDNKENPQQEGAKGAKPCAVSAGRSKGNGLQNPEPRGANMSEPRLSRRQVSSPNAQKPFAHYQRHCRVEYISSPLKSHPLRELKKSKGGKRSLSNRLQHLGHQPTRSAKKPYKCDDCGKSFTWNSELKRHKRVHTGERPYTCGECGNCFGRQSTLKLHQRIHTGEKPYQCGQCGKSFRQSSNLHQHHRLHHGD

SEQ ID NO: 866 - DNA, 1627 bp, Homo sapiens
gcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaaaaaaaaaaaaaa

SEQ ID NO: 867 - protein, 115 aa, Homo sapiens
MSYKPNLAAHMPAAALNAAGSVHSPSTSMATSSQYRQLLSDYGPPSLGYTQGTGNSQVPQSKYAELLAIIEELGKEIRPTYAGSKSAMERLKRGIIHARGLVRECLAETERNARS

SEQ ID NO: 868 - DNA, 2352 bp, Homo sapiens
gtcaagcagcctggctcatggctgtgtgcggcctggggagccgtcttggcctggggagccgtcttggcctgcgcgggtgcttcggcgccgccaggctcctgtatccccgtttccagagccgcggccctcagggcgtggaagacggggacaggccacagccttcctcgaagacacccaggatccccaagatttacaccaaaacgggagacaaagggttttctagtaccttcacaggagaaaggagacccaaagatgaccaagtgtttgaagccgtgggaactacagatgaattaagttcagctattgggtttgctctggaattagtcacagaaaagggccatacatttgccgaagagcttcagaaaatccagtgcacattgcaggacgtcggctcggccctggcgacaccatgctcctcggcccgggaggctcacttaaagtataccacgttcaaggcggggcccatcctggagctggagcagtggatcgacaagtacaccagccagctcccaccactcacggccttcatcctgccttcgggaggcaagatcagctcggcgctgcatttctgccgggccgtgtgccgccgggccgagagacgtgtggtgcctcttgtccagatgggagagaccgatgcgaacgtggccaagttcttaaacagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtgatttacctgtgccaaaggtgctttaaatgtcacatttgtaaaggggaaggcggacaagatttggaagtttagtcacctctgagccacccatcaccgccaaagtgtgggggaaggatagctgcagattgacaggcgaggctcagaaactcctggcttagattgaagtgtgtgtgatgggggtgcagcttagaggaccccctctgaaagggatggagatgctgatgagaacaacactaccacttgaaggtgaacattccctgtctggttggactgagtcaagggtctgcggtgcagcatcttcagcttgagaaaatgaggttgtcagtttccagcaaggctgacatccaccagactgatttctccgatgttgcacttggctggcttatgcctctgagatcggtgccacggctgtatttatttcagttgtcactgctgctccctcctgctatgaaacgacactgccagtgccagcagtgtccttgggaaaggcaatatttatgaagggcagaagaggcagccccaagaacctaaagactgcaggctgctaattgcaggaaatgactttggaagggcaggctcttgtccagtttcagggctgaaatgcctggcgaactccattcagccatcacatattgactgagtggctgcttagcatgggccaccgcgctaggctcgggacagctggtctttccggccatctttcttgctggcaagtcagcaaacattaccttcttagtcacgtgcatatttttgccttcattcttaccacctggcctgcaaagtttgcaggagggccaggtatattcacttgtgtcttctgggtcctttcattgctgacaggctgtgatggccctcttgagccttgggcagggtgggtgaggtgcagatgaccaggagtgtgtgaatgccttccaggaggtggctttgttccgtgcctccctgcccccatcgtcactaccaggtctggtacggagtcggtgctcagtgtttgcaaaacagagctgaaaacggactttgggaggccgaggcaggcagatcacctgaggtcaggagtttgagaccagcctggtcaacatggtaaaaccccatttctgctaaaaaaaaaaaaaaaaaaaaaaaaaaaa

SEQ ID NO: 869 - protein, 250 aa, Homo sapiens
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYMKNDPSAESEGL

SEQ ID NO: 870 - DNA, 921 bp, Homo sapiens
gcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagatttccaagccagcgccctactgggaaggaacagctgtgatcgatggagaatttaaggagctgaagttaactgattatcgtgggaaatacttggttttcttcttctacccacttgatttcacatttgtgtgtccaactgaaattatcgcttttggcgacagacttgaagaattcagatctataaatactgaagtggtagcatgctctgttgattcacagtttacccatttggcctggattaatacccctcgaagacaaggaggacttgggccaataaggattccacttctttcagatttgacccatcagatctcaaaggactatggtgtatacctagaggactcaggccacactcttagaggtctcttcattattgatgacaaaggaatcctaagacaaattactctgaatgatcttcctgtgggtagatcagtggatgagacactacgtttggttcaagcattccagtacactgacaaacacggagaagtctgccctgctggctggaaacctggtagtgaaacaataatcccagatccagctggaaagctgaagtatttcgataaactgaattgagaaatacttcttcaagttatgatgcttgaaagttctcaataaagttcacggtttcattacca

SEQ ID NO: 871 - protein, 271 aa, Homo sapiens
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 872 - DNA, 1136 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcaa

SEQ ID NO: 873 - protein, 194 aa, Homo sapiens
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 874 - DNA, 1464 bp, Homo sapiens
agccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 875 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 876 - DNA, 3214 bp, Homo sapiens
gggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaaaaaaaaaaaaaaaaaaaa

SEQ ID NO: 877 - protein, 369 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 878 - DNA, 2093 bp, Homo sapiens
cgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaattcgggcgtacatgtgcagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaaaaaaaaaaaaaaaaaaaaaaaaaaaaaaaaaaaaaaaaaaaaaaaaaaaa

SEQ ID NO: 879 - protein, 142 aa, Homo sapiens
MGDVKENYLETFISSPKFGRTCADGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 880 - DNA, 551 bp, Homo sapiens
aatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtgacatcctcaggacacacccatgtggctcctggacaatccaagagcagccaaatcctgcttttccagtttggctccacaagtcctccaggacagagccctcaaagcaactcccaacgagttctcaggattcaggctctggcttcaaccaaacagaactcattttgaacaccctgactgcatttttgcttttagaaagttagaataaatatggcgctttgggatcacatagttgatggagaggaaaaaaaaaaaaaaaaaaaaaaaaaaaaaaaaaaaaaaaaaaaaaa

SEQ ID NO: 881 - protein, 87 aa, Homo sapiens
MAVLVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 882 - DNA, 1029 bp, Homo sapiens
attgcaggctgggtagctggtagaaatgttgtgggcgtttgtaagtggaagatttacgccattataaccctaatatattcctgcagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgttaaaaaaaaaaaaaaaaaaaa

SEQ ID NO: 883 - protein, 153 aa, Homo sapiens
MPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 884 - DNA, 1023 bp, Homo sapiens
ggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaatttgtctcaaaactgttctgttcatgatgtattagaaatattttactcagactttaaatattttaaatctcagattggttattcagagtaaccttagaacagaaattgggaatatatctttacaatgattgataccatggtatattgactcttagatgctattgatctgtagcaccattttttacaaacgactaaggaaaaaacctgccaattaaatcatgatatgccatcaattatgagacatcccaatttgagagatgttagattatagaaaagtatgcatttatgactgaaatggtagtggaattatttgaattctacaccaagcacttaccatgtgccaggccctttgca

SEQ ID NO: 885 - protein, 66 aa, Homo sapiens
MAGGKAGKDSGKAKAKAVSRSQRAGLQFPVGRIHRHLKTRTTSHGRVGATAAVYSAAILEYLTAEV

SEQ ID NO: 886 - DNA, 941 bp, Homo sapiens
cgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgaaaaaaaaaaaaa

SEQ ID NO: 887 - protein, 201 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 888 - DNA, 483 bp, Homo sapiens
gcttccggtagtgagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaaaaaaaaaaaaaaaaaa

SEQ ID NO: 889 - protein, 87 aa, Homo sapiens
MAKHLKFIARTVMVQEGNVESAYRTLNRILTMDGLIEDIKHRRYYEKPCRRRQRESYERCRRIYNMEMARKINFLMRKNRADPWQGC

SEQ ID NO: 890 - DNA, 939 bp, Homo sapiens
gcttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacgcgtctttgtggtaacgccctgctgccatctcttttcttctctatgcgaggatttggactggcagtgagaataagagacaacgattcacgtctactttctaggatgacttccatgtgctccatctcgcgcgtccctgagcatgttgaatttccaaatcctaaataagccgcgcggtgtagtttgtattatgttgcgtttctctttctgctttcctcgccctttctccatcatcctttaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaagaaggcctccaaatatagaaacaatcccattagtca

SEQ ID NO: 891 - protein, 87 aa, Homo sapiens; identical to SEQ ID NO: 889

SEQ ID NO: 892 - DNA, 3016 bp, Homo sapiens
gctccaggaagtgcgggggctccagccgcccggccggccgcgatgcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagaaacttcagcgttcccaattatggcttctctcagatccagccttgaagttctttgacctcctcaattcacaacctgtagctgactttagccacccacaagtacagaaaataatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactg

SEQ ID NO: 893 - protein, 121 aa, Homo sapiens
MAASRRLMKELEEIRKCGMKNFRNIQVDEANLLTWQGLIVPDNPPYDKGAFRIEINFPAEYPFKPPKITFKTKIYHPNIDEKGQVCLPVISAENWKPATKTDQETSAFPIMASLRSSLEVL

SEQ ID NO: 894 - DNA, 849 bp, Homo sapiens
tttttttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaaaaaaaaaaaaaaaaaa

SEQ ID NO: 895 - protein, 117 aa, Homo sapiens [sequence omitted]

SEQ ID NO: 896 - DNA, 869 bp, Homo sapiens
ccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaaaaaaaaaaaaaaaaaa

SEQ ID NO: 897 - protein, 117 aa, Homo sapiens [sequence omitted]

SEQ ID NO: 898 - DNA, 1537 bp, Homo sapiens
ccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaaggaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 899 - protein, 238 aa, Homo sapiens
MAAAVGRLLRASVARHVSAIPWGISATAALRPAACGRTSLTNLLCSGSSQAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 900 - DNA, 4073 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttgtcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaaaaaaaaaaaaa

SEQ ID NO: 901 - protein, 411 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 902 - DNA, 1680 bp, Homo sapiens
gtgaggccttggacctgtggcctttgggcttgggtgtctcctgtccgctctgccagtgagtcctcagctctccgtacgtggcccgtcgcccgcggcaagacggagggaaggcgctagttcagtttagctagcaatgcccttcttgcgcgaggactgctggctggtggcgaggcccaggagcctgtttgggtgttaacagttaaaacagtaaagtttgcgcgggcttctgtggttttcagtcttttccccacttcacgtgatctcatttcattgagcaacattaaccaccatttaagatacgtgaaacctgcgaagtggaaaggtgcacgcaaagttaatttacaccccccgcgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 903 - protein, 233 aa, Homo sapiens
MLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 904 - DNA, 2341 bp, Homo sapiens
ggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaaaagcttgtcttcgtccatctgttgacaaatgacagacctttttttttcccccatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactgtacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcattggaaagagtgccagtcagcagtcatgca

SEQ ID NO: 905 - protein, 395 aa, Homo sapiens
MPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 906 - DNA, 961 bp, Homo sapiens
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcat

SEQ ID NO: 907 - protein, 239 aa, Homo sapiens
MAPSVPAAEPEYPKGIRAVLLGPPGAGKGTQAPRLAENFCVCHLATGDMLRAMVASGSELGKKLKATMDAGKLVSDEMVVELIEKNLETPLCKNGFLLDGFPRTVRQAEMLDDLMEKRKEKLDSVIEFSIPDSLLIRRITGRLIHPKSGRSYHEEFNPPKEPMKDDITGEPLIRRSDDNEKALKIRLQAYHTQTTPLIEYYRKRGIHSAIDASQTPDVVFASILAAFSKATCKDLVMFI

SEQ ID NO: 908 - DNA, 2875 bp, Homo sapiens
acggctccgcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagccaaaaaaaaaaaaaaaaaaaaaaaaaaaaaaaaaaaaaaaaaaaaaaaaaa

SEQ ID NO: 909 - protein, 220 aa, Homo sapiens
MALHSMRKARERWSFIRALHKGSAAAPALQKDSKKRVFSGIQPTGILHLGNYLGAIESWVRLQDEYDSVLYSIVDLHSITVPQDPAVLRQSILDMTAVLLACGINPEKSILFQQSQVSEHTQLSWILSCMVRLPRLQHLHQWKAKTTKQKHDGTVGLLTYPVLQAADILLYKSTHVPVGEDQVQHMELVQDLAQGFNKKYGEFFPVPESILSMCVLVFLT

SEQ ID NO: 910 - DNA, 1557 bp, Homo sapiens
ggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaaaaaaaaaaaaaaaaaaaaaaaaaaaaaaaa

SEQ ID NO: 911 - protein, 355 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 912 - DNA, 796 bp, Homo sapiens
gggagctgccgggagttggagcctgcggagttcgagaccatgctgctgttctgccccggctgcgggaacgggctgatcgtggaggagggacaacgctgccaccgcttcgcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcattt

SEQ ID NO: 913 - protein, 108 aa, Homo sapiens
MLLFCPGCGNGLIVEEGQRCHRFACNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 914 - DNA, 927 bp, Homo sapiens
ggcagcgggcgaaaggagccggggcctggaggtttgcgtaccggtcgcctggtcccggcaccagcgccgcccagtgtggtttcccataaggaagctcttcttcctgcttggcttccacctttaacccttccacctgggagcgtcctctaacacattcagactacaagtccagacccaggagagcaaggcccagaaagaggtcaaaatggggtttatattttcaaaatctatgaatgaaagcatgaaaaatcaaaaggagttcatgcttatgaatgctcgacttcagctggaaaggcagctcatcatgcagagtgaaatgagggaaagacaaatggccatgcggattgcgtggtctcgggaattcctcaaatattttggaactttttttggccttgcagccatctctttaacagctggagcgattaaaaaaaagaagccagccttcctggtcccgattgttccattaagctttatcctcacctaccagtatgacttgggctatggaacccttttagaaagaatgaaaggtgaagctgaggacatactggaaacagaaaagagtaaattgcagctgccaagaggaatgatcacttttgaaagcattgaaaaagccagaaaggaacagagtagattcttcatagacaaatgaaatcatgcttaccaatcaaatctcaaagcacagaattattgacttgaatcatggtttttacagttttttaaatgctcaagattttgatattatagattttattttaaaatattaaaatgcaagatagttttgagctattttaaaataaaatttataacattcaacacaaaatcatggaggtgctctaaataacttttagatttcctctctctgtgtgcattaccaatatctaagtgtaaaattaataaattgttttgaattcctggaaaaaaaaaaaa

SEQ ID NO: 915 - protein, 147 aa, Homo sapiens
MGFIFSKSMNESMKNQKEFMLMNARLQLERQLIMQSEMRERQMAMRIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 916 - DNA, 2195 bp, Homo sapiens
tcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacgggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaaaaaaaaaaaaaaaaaa

SEQ ID NO: 917 - protein, 620 aa, Homo sapiens
MALGEEKAEAEASEDTKAQSYGRGSCRERELDIPGPMSGEQPPRLEAEGGLISPVWGAEGIPAPTCWIGTDPGSPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQTFCCQLEELICWLYNVADVTDHGTAARSNLTSLKSSLQLYRQFKKDIDEHQSLTESVLQKGEILLQCLLENTPVLEDVLGRIAKQSGELESHADRLYDSILASLDMLAGCTLIPDKKPMAAMEHPCEGV

SEQ ID NO: 918 - DNA, 928 bp, Homo sapiens
gcgcgcagcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaaaaaaaaaaaaaaaaaaaaa

SEQ ID NO: 919 - protein, 197 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLKLPPKGAWRPSLNIATVLTSIQLLMSEPNPDDPLMADISSEFKYNKPAFLKNARQWTEKHARQKQKADEEEMLDNLPEAGDSRVHNSTQKRKASQLVGIEKKFHPDV

SEQ ID NO: 920 - DNA, 2251 bp, Homo sapiens
gcgcaacgtcatttccgcgtacgggggagggcgggcctggagtctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgaaaaaaaaaaaaaaaaaaaaaaaaaaaaaaa

SEQ ID NO: 921 - protein, 416 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 922 - DNA, 1231 bp, Homo sapiens
cgactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagataaaaaaaaaaaaaaaaaaaa

SEQ ID NO: 923 - protein, 117 aa, Homo sapiens
MQKSCEENEGKPQNMPKAEEDRPLEDVPQEAEGNPQPSEEGVSQEAEGNPRGGPNQPGQGFKEDTPVRHLDPEEMIRGVDELERLREEIRRVRNKFVMMHWKQRHSRSRPYPVCFRP

SEQ ID NO: 924 - DNA, 1388 bp, Homo sapiens
ttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtttgttggagactgaaccgttgcaaggaacagacgaagatgcagtagccagtgctgacttctctagcatgctctctgaggaggaaaaggaagagttaaaagcagagttagttcagctagaagacgaaattacaacactacgacaagttttgtcagcgaaagaaaggcatctagttgagataaaacaaaaactcggcatgaacctgatgaatgaattaaaacagaacttcagcaaaagctggcatgacatgcagactaccactgcctacaagaaaacacatgaaaccctgagtcacgcagggcaaaaggcaactgcagctttcagcaacgttggaacggccatcagcaagaagttcggagacatgagttactccattcgccattccataagtatgcctgctatgaggaattctcctactttcaaatcatttgaggagagggttgagacaactgtcacaagcctcaagacgaaagtaggcggtacgaaccctaatggaggcagttttgaggaggtcctcagctccacggcccatgccagtgcccagagcttggcaggaggctcccggcggaccaaggaggaggagctgcagtgctaagtccagccagcgtgcagctgcatccagaaaccggccactacccagcccatctctgcctgtgcttatccagataagaagaccaaaatcccgctgggaaaaacccaggccttgacattgttattcaaatggcccctccagaaagtttaatgatttccatttgtatttgtgttgatgatggaccacttgaccatcacatttcagtattcatagatgactgtcacattttaaaatgttcccacttgagcaggtacacaactggtcataattcctgtctgtgtaattcgatgtatatttttccaaacatgtagctattgtttgctttgatttttgcttggcctcctttatgatgtgcatgtccttgaaggctgaatgaacagtccctttcagttcagcagatcaacaggatggagctcttcatgactgtctccagcaataggatgatttactataaatttcatccaactacttgtgatctctctcacctacatcaattatgtatgttaatttcagcaattaaaagaattgattttaatgacaaaaaaaaaaaaaaaaaa

SEQ ID NO: 925 - protein, 204 aa, Homo sapiens
MEAQAQGLLETEPLQGTDEDAVASADFSSMLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 926 - DNA, 2012 bp, Homo sapiens
acactgctcagggaagagcctgctacggtggactgtgagactcagtgcactgtcctcctcccagcgaccccacgctggaccccctgccggaccctccacccttcggcccccaagcttcccaggggcttcctttggactggactgtccctgctcatccattctcctgccacccccagacctcctcagctccaggttgccacctcctctcgccagagtgatgaggtcccggcttctgctctccgtggcccatctgcccacaattcgggagaccacggaggagatgctgcttgggggtcctggacaggagcccccaccctctcctagcctggatgactacgtgaggtctatatctcgactggcacagcccacctctgtgctggacaaggccacggcccagggccaacccaggccaccccacaggccagcccaggcctgccggaagggccgccctgctgtgtccctgcgagacatcaccgcacgtttcagtggccagcagcccacactgcccatggctgatactgtggaccccctggactggctttttggggagtcccaggaaaagcagccaagccagagggacctgccaaggaggactggcccctctgctggcctctggggtccacatagacagatggacagcagcaagcccatgggggcccccagagggaggctctgtgaagccaggatgcctgggcattccctggcaagaccaccgcaggatgggcagcagagctctgacctaagaagctggacttttgggcagtctgcccaagccatggcctcccgccaccgcccccgccccagcagtgtcctcagaacactctactcgcacctcccggtgatccatgaactctgacccctccccagtaaaggcttctgtagagagcatgctgggtctgcatctcctctcgtctcctccatggtggtcactgcccctggcaggtctctgaaagggaaatgcttttctgcagaggcccctgcttgggcagttcacagtgagaccgaccccctctgaatatgataacagcctgtttcacatgaggagatgttaccaatcccgttcgctctgacccttgctggctgatcaccttgagcaacttacttaacatctgtgttcctcagtttctcatgggtaatatagggataattactggcacctgcctcccaggccattctgacgtgtaaccgcatataggagcccactggctgagtagctaccatcatcgctggtggggaaactggtggtaggggtgtgagggtagtgggggtgtcagccccccaggtgtttcagaacaaggcctcgggcactcccaagtctgcctcttggctcccaccctcaaagcccatgttctgtgaggcccaagagaacacatggagtcttagcaaatgcactaatgtattccgggggactgtcacctggcaccactggggcactctgctggctacaactcatacgtcctgtggtggcattgggagagttcccccatgatgagggccaagatagaatctgtaccactcagtgctaccatccccacccctacaccacttccacacaggggcctcatggcatggtcagggtcccagctgtgggtgagagcagggcactgtccagctgtccactggggaagtcaagatgtcctaaggcccaggtcagggcatctggagtctgaaggaccctagttcctagaggcatctggcagcaagaaggtgaggcatcagggaacgggaatcaggctgggactgatcagaggtgaagggacagagagaggagaggaggaagattgagctgggggcaacagccaagctcacctgggcaggtctctgccacctccttgctctgtgagctgtcagtctaggttattctctttttttgtggctatttttaattgctttggatttgttaaatgttttctgtcttctgttaagtgtgttttctctggagatagaatgtaaaccatattaaaaggaaaaagtttcagacaagcaaaaaaaaaaaaaaaaaaaaaaaaaaa

SEQ ID NO: 927 - protein, 212 aa, Homo sapiens
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 928 - DNA, 1993 bp, Homo sapiens
aaccaatcctcacaacaggactgggagacaggtgttacctttcccactttacagagaatgaaacagagtggcaaagcctccgaaggaccctacacttcggacatcgcaaagcaggatctgagtcccggctcctctgtccaaacctacttgctaggctttctttcccatgtctactctatagctggaaaggtcgtggaggacacattttaggccaaccctctcggtttacaatccagagaggggagaccctcagaagccaagcgacatgtccacggctacgcggcgagtgtgtggcaacgtggaaggggagcccgagacgccctggtctctcccttctctcgcaggttcctttctccccgaacgcagcccgcaggggacgctggaggaggagctgagctggagttgccggggccccgggaccgggcgttccgggggcggtccccagcagccgcgcattccagagccagcagcgcgtcctggccgctcctgcgctctcccgcctcccggggctcggaggagccggggcacgttccaggagctgcctagggctgaggttccaggcctgggggtcgcttccagctgccagatcccgtgcagtcctggggaccctgagaagcaccgagccatccctgacccaggaactttccgcagactcgccgccatctgggagtgaagcaacatggatgcagtcagccaagtccccatggaagtcgtgcttcccaagcacatcctggatatctgggttattgtcctcatcatcctggccaccattgtcatcatgacctcgttgttgctgtgcccagccactgcagtaatcatctatcgcatgcggactcatccgatccttagtggggctgtttgagagcctcccaagagggccgggtgagggatgaggacaggcatcctatccccagcctcttcctgtcttcagaaaagcagcaggagggactttggggcatggacctgagttctggttttgattctgccacgagccagctgtgtgaatttggtcaagggacctaactctctgagttccaggttccttatctttcaaatggggatggtgatccctgccctttctacctcatagggatgtgagaaccacctgacttagtggatgtgaaagctgtttgtgatcagtaaagctaccacagatataagggtgttatgctgaatcctgagaagctttcaagaaccagagaacctgattgctgatgatggccttaaaggtggtgagggagatactgggggcagagcagactttgccagtgcccctcaggtcaaaccaagccaagagcaccctgtccccattccaaggggccagcagcactttggcccaaagtattttctttaaggtgccattccttcatgttttctcagtttggagggtgatgggtagagctttccagaaccttctccattccagaatctctgcccctgtgtaatctgaaggaaggctgtgccatctttgggcactgccaagggagttggggtgatgggcttctttctgcactggagtctcacatctgttagctttgacactcaagcaatgttggaaaatgcagggtgactgagttccctgcccagctttcgggatctctggcccccatccccttgtgtgtgtccctctgcccagctcctgctgtaattagctccacgtgtacccccttcactccctcccaccagctctgcagccagcctatggcaattatattttaagaggtgttcccaggacttttgggacctactaaaacaatgatggttattttagatgtgatgatttatatttatgtagagatatttctggaccactcaagctcttcgataccaaaatcaggagcatcttgggatttattaaattatgtaagaagatagcacagatatcgggatattattgtgtgaaaatgctgcttttactttgatgtgatctcattgatgtacacaaccaagttccaataaagtgctagaatgtgcaaaaaaaaaaaaaaaaaaa

SEQ ID NO: 929 - protein, 135 aa, Homo sapiens
MSTATRRVCGNVEGEPETPWSLPSLAGSFLPERSPQGTLEEELSWSCRGPGTGRSGGGPQQPRIPEPAARPGRSCALPPPGARRSRGTFQELPRAEVPGLGVASSCQIPCSPGDPEKHRAIPDPGTFRRLAAIWE

SEQ ID NO: 930 - DNA, 3226 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 931 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQMYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 932 - DNA, 5666 bp, Homo sapiens
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtcccgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaa

SEQ ID NO: 933 - protein, 242 aa, Homo sapiens
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 934 - DNA, 434 bp, Homo sapiens
gcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggtgtttgcacttgtgacagcagtatgctgtcttgccgacggggcccttatttaccggaagcttctgttcaatcccagcggtccttaccagaaaaagcctgtgcatgaaaaaaaagaagttttgtaattttatattactttttagtttgatactaagtattaaacatatttctgtattcttccaaaaaaaaaaaaaaaaaaaaaaaaaaa

SEQ ID NO: 935 - protein, 67 aa, Homo sapiens
MDNVQPKIKHRPFCFSVKGHVKMLRLVFALVTAVCCLADGALIYRKLLFNPSGPYQKKPVHEKKEVL

SEQ ID NO: 936 - DNA, 1305 bp, Homo sapiens
cctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagaaaaaaaaaaaaaaaaaaaaaaaaaaaaaaaaaaaaaaaa

SEQ ID NO: 937 - protein, 56 aa, Homo sapiens
MVTRFLGPRYRELVKNWVPTAYTWGAVGAVGLVWATDWRLILDWVPYINGKFKKDN

SEQ ID NO: 938 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 939 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 940 - DNA, 1709 bp, Homo sapiens
acactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaaa

SEQ ID NO: 941 - protein, 122 aa, Homo sapiens
MSTPARRRLMRDFKRLQEDPPAGVSGAPSENNIMVWNAVIFGPEGTPFEDVYADGSICLDILQNRWSPTYDVSSILTSIQSLLDEPNPNSPANSQAAQLYQENKREYEKRVSAIVEQSWRDC

SEQ ID NO: 942 - DNA, 2070 bp, Homo sapiens
cgctgtttcgtgggaccaggattgaaacaagatggcgggttcgtggtgagaagccgtcaaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaaaaaaaaaaaaaaaaaaaaaaaaaaaaaaaaaaaaaaaaaaaaaaaaaaaa

SEQ ID NO: 943 - protein, 142 aa, Homo sapiens
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 944 - DNA, 2073 bp, Homo sapiens
cgctgtttcgtgggaccaggattgaaacaagatggcgggttcgtggtgagaagccgtcaagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaaaaaaaaaaaaaaaaaaaaaaaaaaaaaaaaaaaaaaaaaaaaaaaaaaaa

SEQ ID NO: 945 - protein, 142 aa, Homo sapiens; identical to SEQ ID NO: 943

SEQ ID NO: 946 - DNA, 493 bp, Homo sapiens
cttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaactaaacccatt

SEQ ID NO: 947 - protein, 140 aa, Homo sapiens [sequence omitted]

SEQ ID NO: 948 - DNA, 2727 bp, Homo sapiens
aatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttgggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcgggaaggagagaaggagaagagttgcgacaaccaccagttaagcgtttgagacttcgtggtgattggtcagatactggacccagagcaaggccggagagtgaacgagaacgagatggagagccagagtccccaatgtgtccattgatgccagagaatgtcctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagatcaaaaaaaaaaaaaaaaaaaaaaaaaaaaaa

SEQ ID NO: 949 - protein, 533 aa, Homo sapiens
MLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSDSPSSVVNKQLGSMSLDEQQDNNNEKLSPKPGTGEPVLSLHYSTEGTTTSTIKLNFTDEWSSIASSSRGIGSHCKSEGQEESFVPQSSVQPPEGDSETKAPEESSEDVTKYQEGVSAENPVENHINITQSDKFTAKPLDSNSGERNDLNLDRSCGVPEESASSEKAKEPETSDQTSTESATNENNTNPEPQFQTEATGPSAHEETSTRDSALQDTDDSDDDPVLIPGARYRAGPGDRRSAVARIQEFFRRRKERKEMEELDTLNIRRPLVKMVYKGHRNSRTMIKEANFWGANFVMSGSDCGHIFIWDRHTAEHLMLLEADNHVVNCLQPHPFDPILASSGIDYDIKIWSPLEESRIFNRKLADEVITRNELMLEETRNTITVPASFMLRMLASLNHIRADRLEGDRSEGSGQENENEDEE

SEQ ID NO: 950 - DNA, 2979 bp, Homo sapiens
gggcagcctgctgtcggcttagaggggatgggcagtgtggagggcctggcagagcaagaggactcatccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtcaaaaaaaaaaaaaaaaaa

SEQ ID NO: 951 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 952 - DNA, 599 bp, Homo sapiens
aggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaaaaaaaaaaaaaaaaaaaaaaaaaaaaaaaa

SEQ ID NO: 953 - protein, 125 aa, Homo sapiens
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 954 - DNA, 577 bp, Homo sapiens
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaaaaaaaaaaaaaa

SEQ ID NO: 955 - protein, 93 aa, Homo sapiens
MAQSGGEARPGPKTAVQIRVAIQEAEDVDELEDEEEGAETRGAGDPARYLSPGWGSASEEEPSRGHRNRSSVNSRTMLASFIVSSAPSTAPST

SEQ ID NO: 956 - DNA, 1467 bp, Homo sapiens
gctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatggcaacagggaggaagctgacaacccaaatacagggattggtgccttccgattcatgctggaatccaacaagggcaaatcaatgttggagttccaggagctaatgacagtttttcaactgctacactggaatggcagccttaaggccatgagggaacgacaatgctctcggcaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctaaaaaaaaaaaaaaaaaaaaaaaaaaaaaaaaaaaaaaaaaaaaaaaaaaaaaaaaaaaaaaaaaaa

SEQ ID NO: 957 - protein, 337 aa, Homo sapiens
METMRAQRLQPGVGTSGRGTLRALRPGVTGAAAATATPPAGPPPAPPPPAPPPPPLLLSGAPGLPLPPGAAGSPAVLREAVEAVVRSFAKHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCSRQEVLAHYSHRALDDDIRHQMALDWVSREQSVPGALSRELASTERELDEARLAGKELRFHKEKKDILVLAAGQLGNMHSSNC

SEQ ID NO: 958 - DNA, 1056 bp, Homo sapiens
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgaaaaaaaaaaaaaaaaaaaaaa

SEQ ID NO: 959 - protein, 108 aa, Homo sapiens
MAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 960 - DNA, 2591 bp, Homo sapiens
gccaagggcactattggccagttccgttcaacgaagtggttgctttttttagttccggcaatgagttgcgccggggcggcggcggctccccgcctttggcggctgcgcccgggggcccggcggtccctctcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcagaaaatgtgggatcaagaaaaggaccatttgaaaaagttcaatgagttgatggttacgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacataggcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattcaaaaaaa

SEQ ID NO: 961 - protein, 217 aa, Homo sapiens
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 962 - DNA, 3008 bp, Homo sapiens
gggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccacagaaaaaaaaaaaaaaaaaaaaaaaaa

SEQ ID NO: 963 - protein, 186 aa, Homo sapiens
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 964 - DNA, 2625 bp, Homo sapiens
gggggcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttatgaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatgggacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccgtcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgcttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggtttttttttttcgtttgttttagtgactaattcaggatgaaagtttttttgttcttgtatttaacccttttttatgagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaaaaaaaaaaaaaa

SEQ ID NO: 965 - protein, 76 aa, Homo sapiens
MARGQQKIQSQQKNAKKQAGQKKKQGHDQKAAAKAALIYTCTVCRTQMPDPKTFKQHFESKHPKTPLPPELADVQA

SEQ ID NO: 966 - DNA, 1317 bp, Homo sapiens
agtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaaaaaaaaaaaaaaaaaaaaaaaaaaaaa

SEQ ID NO: 967 - protein, 329 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQHHMRATGGKMAYLLIEEDIRDLAASDDYRGCLDLKLEELKSFVLPSWMVEKMRKYMETLRTENEHRAVEAPPQT

SEQ ID NO: 968 - DNA, 685 bp, Homo sapiens
gccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgaaaaaaaaaaaaaaaaaa

SEQ ID NO: 969 - protein, 130 aa, Homo sapiens
MQERTGAATARRESLPQANNPEQLCKQRCINEASWTMKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 970 - DNA, 1227 bp, Homo sapiens
gcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgctttgccagatacaagctgaagtgctaccagaaaaccagttgttaagtctatctggaaaaatagactgtgaagcacctcatcttcatttcaatagcttcgctggaacctggagcctaaggggtaaaatgtattatctttctcttcacaaacagttttttttcttttatggaacatagaatatgacaacatttgttttgtcaactgattacattttaaaacattgtacttgttcatattgtacttggctttgaaataccctgaagcatctatggaattgtaatttattgtaatgcaataagcatttatgtaattaaaaaaaagcattcttaaatatgaaaaaaaaaaaa

SEQ ID NO: 971 - protein, 142 aa, Homo sapiens
MNQSRSRSDGGSEETLPQDHNHHENERRWQQERLHREEAYYQFINELNDEDYRLMRDHNLLGTPGEITSEELQQRLDGVKEQLASQPDLRDGTNYRDSEVPRESSHEDSLLEWLNTFRRTGNATRSGQNGNQTWRAALPDTS

SEQ ID NO: 972 - DNA, 1102 bp, Homo sapiens
agcggagaggtttcagcaacaccagtggcctacagagaaggagccttcctcctctccccagactccagactctaaagggcgacctcctcctgctcctgctcctggagcgcagccagcgcacagcgtttccgcaggaatcttgagaatggcaaggcccgcacacccgcggtggttcccaggcccgccccctctcgcagctgcagccccacctgccagtgcgtgccgcctccgagcgacttccgggagccgggcggccaccgcggtgcaggcgcgcgcccaaaggctttgcgaggctcactcggtctgagaggtcggaggctgcgagtgtcgctgctgaaggctgtggtggaccgggctggatcgcggattttggattagataatagatttgggatcgccgattgggggttggattgcggatttggggttggataggggatttggggctgggtcggcgggggcaggggcggggaggtgaaaaggtgacagggagctgcctcctctcaagagcagttggttgggagtctgagaagtcaccaccatgaagttgttcggcttcaggagccacaggggccagacggtcctgggcaccatagaccacctgtacacgggttccgggtaccgaatccggtactcggaactgcagaagatccacaaggcagctgtcaagggcgacgccgcggagatggagcgctgtctggcgcgcaggagcggagacctggacgccctggacaagcagcacagcagtgtgtccccaagaaagtgtcagagcctttacgtggaccttcccatggaaaaggaaacagaatagtcaatggaaaaggagaaggacctcctgcaaaacatccttccttgaagcctagcactgaaatggaagatcctgctgtgaaaggagcagtacaaagaaagaatgtacagacattgagagcagaaaaagccttaccagtggcttcagaggaagagcaacaaaggcgtgaaagaagtgaaaagaagcaaccacagctaattttagaacatgcactctgacagaaaagacatctgagaaacaaaacaagcaaatttgttttcctttttgcacctgccaaaaaaaaaaaaaaaaaaaa

SEQ ID NO: 973 - protein, 89 aa, Homo sapiens
MKLFGFRSHRGQTVLGTIDHLYTGSGYRIRYSELQKIHKAAVKGDAAEMERCLARRSGDLDALDKQHSSVSPRKCQSLYVDLPMEKETE

SEQ ID NO: 974 - DNA, 2676 bp, Homo sapiens
atattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacgccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctg

SEQ ID NO: 975 - protein, 298 aa, Homo sapiens
MTSLTQRSSGLVQRRTEASRNAADKERAAGGGAGSSEDDAQSRRDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 976 - DNA, 3925 bp, Homo sapiens
agcggggctgcgcgaagtcatcgctgttccagacagcgatgactcgagagcggtgggggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaatatttccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattaggcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaacaaaaaacaacaccaaaaaaacagcagtgatatatatattccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtattgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctcaaaaaaaaaaaaaaaaaaaaaaaaaaaaaaaaaaaaaaaaaaaaaaaaaaaaaaaaaaaaaaaaaaa

SEQ ID NO: 977 - protein, 167 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 978 - DNA, 2084 bp, Homo sapiens
agcggggctgcgcgaagtcatcgctgttccagacagcgatgactcgagagcggtgggggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaatatttccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattaggcctgtgcaaaaccatctgtttggggagcacactcttggcacatagatctccctgtggtgggatttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccac

SEQ ID NO: 979 - protein, 167 aa, Homo sapiens; identical to SEQ ID NO: 977

SEQ ID NO: 980 - DNA, 1760 bp, Homo sapiens
aaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcatcggcggcggcggcggcgtgaggggccgggcggtgtaaacagccccggaggcggcggtcgagaccccgagggggaagcggcggctgagtcagggtcgcgcctccgttggaaacttgggctgagtaccgcggcgggcgcgagcgaggcgccctagacatcttctccctcccttgcctcagggaagtcgagataacatgagtattgtactagtttgcttttcaaatgctcccaaggtctcagatgaagcggtgaaaaaagattcagagttggataagcacttggaatcacgggttgaagagattatggagaagtctggcgaggaaggaatgcctgatcttgcccatgtcatgcgcatcttgtctgcagaaaatatcccaaatttgcctcctgggggaggtcttgctggcaagcgtaatgttattgaagctgtttatagtagactgaatccacatagagaaagtgatggggcctccgatgaagcagaggaaagtggatcacagggaaaattggtggaagctctcaggcaaatgagaattaatcataggggaaactaccgacaacttctggaggagatgctgactagttacaggctagctaaagtagagggagaagaaagccctgctgaaccagctgccacagctacttcttcgaacagtgatgctggaaacccagtgacaatgcaggaaagccatactgaatcagaaagtggtcttgctgaattagacagctctaatgaagatgcagggacaaagatgagtggtgaaaaaatatgactttcctttttggtaatatttttgtgatctttgatggtttttaacctaggaagtgtaatgtatgcatttatataactgttttgttatttgaatcttggaaaactagttttattatattcagatagccttgttttttaaaaaggcctttgcatacacctttatgagatagtgtaaaattgactatttatagtactatggatttaatgaaattatatgtcatttcacattgtatgccagaaattaggctaccaattatgaattaaagtcagtagttaaattaatactagatagaattagaaattttgattagagagattatgctatattatggaaaaacttgttaatgtagaattatactgcttcatattattttacctattagtacactcatagttagctttgtaataaatttatgttttctttaataattttagttcttcaaagaatggctgatgctggcctgtaatttttctttcaaggatgataatttgtgtgttgtttgatttgtttatattttacatctctgtagttttatttttagaagttgtgagatattggatgtgtggctatttttcctttctctgtattctttatgaaacataacttttgaaaaacctatgtattattcatacagctttggtttgtatattctgtatagcctaactacacacatcaaaatgtatgtcaaccaagtgtttagaatgaaattataagtgtttaagtccaaataaagcatgtgatgtggaataatctaaaaaaaaaaaaaaa

SEQ ID NO: 981 - protein, 192 aa, Homo sapiens
MSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 982 - DNA, 529 bp, Homo sapiens
cgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaacta

SEQ ID NO: 983 - protein, 151 aa, Homo sapiens [sequence omitted]

SEQ ID NO: 984 - DNA, 2164 bp, Homo sapiens
ataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctgaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 985 - protein, 381 aa, Homo sapiens
  VARIANT 59, 300, 318, 330, 345, 352, 367, 369, 376, 378: Xaa = selenocysteine
MWRSLGLALALCLLPSGGTESQDQSSLCKQPPAWSIRDQDPMLNSNGSVTVVALLQASXYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSXCCHCRHLIFEKTGSAITXQCKENLPSLCSXQGLRAEENITESCQXRLPPAAXQISQQLIPTEASASXRXKNQAKKXEXPSN

SEQ ID NO: 986 - DNA, 1113 bp, Homo sapiens
agcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttcctacaaaaaaaaaaaaaaaaagaaaaaaaaaaaa

SEQ ID NO: 987 - protein, 121 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 988 - DNA, 2176 bp, Homo sapiens
gaacccggtctcccgcaagatggagccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagatcaatacagattctttttcttcctatcctgttttctctcctgtttctttggattatagcagtgaacctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctccctttttttcgcgttgtttcctttttttaaattgagttatgacaaataaaaaattgcatat

SEQ ID NO: 989 - protein, 488 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQINTDSFSSYPVFSPVSLDYSSEPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 990 - DNA, 3021 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaaaaaaaaaaaaaaaaaaaaaa

SEQ ID NO: 991 - protein, 537 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVASSAPPLTGKRGRGRPRKANLLDSMFGSPGGLREAGILPCGLCGKVFTDANRLRQHEAQHGVTSLQLGYIDLPPPRLGENGLPISEDPDGPRKRSRTRKQVACEICGKIFRDVYHLNRHKLSHSGEKPYSCPVCGLRFKRKDRMSYHVRSHDGSVGKPYICQSCGKGFSRPDHLNGHIKQVHTSERPHKCQVWVGSSSGLPPLEPLPSDLPSWDFAQPALWRSSHSVPDTAFSLSLKKSFPALENLGPAHSSNTLFCPAPPGYLRQGWTTPEGSRAFTQWPVG

SEQ ID NO: 992 - DNA, 726 bp, Homo sapiens
gccttccttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaaaaaaaaaaaaaaaaaaaaaaaaaaaaaaaaaa

SEQ ID NO: 993 - protein, 133 aa, Homo sapiens
MEEDQELERKISGLKTSMAEGERKTALEMVQAAGTDRHCVTFVLHEEDHTLGNSLRYMIMKNPEVEFCGYTTTHPSESKINLRIQTRGTLPAVEPFQRGLNELMNVCQHVLDKFEASIKDYKDQKASRNESTF

SEQ ID NO: 994 - DNA, 1865 bp, Homo sapiens
cacgtgaccaagagccgcctagagcacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcaggtggagcaaggccctctcctgtcctgccccaaggctggcacagacttgagcatgggccgggctcgggaagtgggttggatggcggcaggactgatgattggggctggtgcctgctactgcgtttacaaactgaccataggaagagatgacagtgagaagctggaggaggagggggaagaggagtgggacgatgaccaggagctggatgaggaggagcctgatatttggtttgattttgaaactatggctcggccctggactgaggatggggattggactgaacctggggccccaggtggcactgaggacaggccctcagggggaggcaaggccaaccgagcacacccaataaaacagcggccattcccctatgaacataaaaatacttggagtgctcaaaattgtaaaaatggcagttgtgttctggacctctccaagtgtcttttcattcagggaaaactgttgtttgccgagcccaaggatgcgggctttccatttagccaggatatcaatagccatttggccagcctctcaatggctagaaacacgagccccactccagaccccactgttagagaggctttgtgtgccccggataacttaaatgcgagtattgaaagtcagggccagattaagatgtacatcaatgaagtgtgtcgggagactgtgtcacgttgctgcaactcatttctgcagcaggccggattaaatttgttaataagcatgacagttattaataacatgcttgccaagtccgcttcagacttgaagtttcctttgatatcagagggaagtggatgtgctaaggttcaggttttgaaaccgctgatgggtttgtctgaaaagccagtcttggcgggggagttagtcggtgcccagatgctcttctcattcatgtccctctttatcagaaatggaaacagagagattctcctggaaacccctgccccataaacggccctctcgaacacaatgggacggaatccacccacaacgcgcttggtttgcagatgtcaaagaatctgcagagggtgctactgaagatccagccttagccaatcaccacctcattgggtgaaagttccagggctcaatccaggaccacactcttattggccaggcaggggctcccacagagctttgagtaacttcttggttgtgcagtctgcaggcaatgttggcattgtaaattcctcccttgcagcctccttcatgtggtgaggggatcacttcagctgcctgctgtggacaaagaacatcaaattacagcatcacgagtgctattgttgcctgtggtggtctccctgtccaagcgggaccgctttgcagagaccagaggcatatcgcggcttgagctgaaaatgcatttgttgcagcttaggttgaattatttttcgtttgctctttcttctacacgcgcctgatggatagtgaacctattcatcaaaaaagtgcactgctcttctgtctattgtaccgacttaacctcttccacccaagtccgcatctgtgtgtatcatcaataaagttgtgtgctttgattggcagaaaagaaaaaaaaaaaaaaaaaa

SEQ ID NO: 995 - protein, 300 aa, Homo sapiens
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 996 - DNA, 993 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaa

SEQ ID NO: 997 - protein, 155 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 998 - DNA, 1593 bp, Homo sapiens
gttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagatgtcctttgtccaatgtgaacatttattcatattgttttgattaccctcgtgttactacaagatggcaataaatactatgggattgtttgtattaaaaaatttacattgcttcttactattcagcagtagaaactttttacacagtaacaccattcgttgttggtatttagttttctgaagggtcgcagttgccttgagcacttggtattcgcagagcttggacctgtagattttgaggcagattaggaattctgcctgatgggtaagcttccagtattgggaggtggagaaggggagggttcagaaaaataaataagagttattgcactaacaaaagtcttcatcacttgtagttctggatgctggaataccagagtttctaacctaaatacgttgggtacattatttaatggggtcagtattgctcaacactctcattgagtcactgtgaggtctttgtgaattttatcgctaagatcagaatgtgagaagtatttggatatagggaaagaatgaagtgcctttcaagtacattaaaaatcagttaagagtttacaggaaagagactgagattggtaatctgaaaaggaccacaagcatagctggtaggcaaattgttaggcagaataatggtatgttggagaaatacacctgtctcttattcttatctcttaagaattttggttcttcccccagtgattgctggttgaattcttatatggacaggtttcccttcccccagtatcgcacatggttctagttagaatcctgttagatagtgagcatctgctgttagctagacactgttgaatcaatacagtgaaacagacaggtaagcaggtggttttaatgcctcattctaagtgctatttaaattggatcttgaaagatgaataaggcctgccttaagttctgctaaaggcaatgttgttattaaggacgggtgaggaaggaccaagaagtctggctcctgcttttctacatgcctgtgaaggagacttttcatgaaactgaataaaagaaatcctttccgagatagaggagatttgtaggtgaatgcagaagtgtatccagctttgaaccatgcattccatctatattcctcctgtctgaactcatgctcttttgattatgttttgaaataaagggctgcattagttcttttaaaaaaaaaaaaaaaaaaaaaaaaaaaaaaaaaaaaaaaaaaaaaaaa

SEQ ID NO: 999 - protein, 92 aa, Homo sapiens
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 1000 - DNA, 2478 bp, Homo sapiens
atcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaaaaaaaaaaaaa

SEQ ID NO: 1001 - protein, 228 aa, Homo sapiens
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 1002 - DNA, 1967 bp, Homo sapiens
ctgtcctgggattgcctggagctccgcaccgcgagtttgccgcggcactttccgcgcggcggaagagcgcgcgccagcttcggcacacctgggagccggatcccagccctacgcctcgtcccctacaagctcctccaagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactattcagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaaaaaaaaaaaaaaaaaa

SEQ ID NO: 1003 - protein, 340 aa, Homo sapiens
MATGGYRTSSGLGGSTTDFLEEWKAKREKMRAKQNPPGPAPPGGGSSDAAGKPPAGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRDLDDIEDENEQLKQENKTLLKVVGQLTR

SEQ ID NO: 1004 - DNA, 2139 bp, Homo sapiens
agacccaagcagctggaggctctgtgtgtgggtcgctgatttcttggagcctgaaaagaaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgatttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcttccttattccccatctggtccagttccttcacttacagatggcagcagtgaggccttggggtagaaggatcctccaaagtcacacagagtgcctgcctcctggtcccctcagctctgcctctgcagcccactgcctgcccagagccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaa

SEQ ID NO: 1005 - protein, 248 aa, Homo sapiens [sequence omitted]

SEQ ID NO: 1006 - DNA, 2096 bp, Homo sapiens
gcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaattaaaaa

SEQ ID NO: 1007 - protein, 187 aa, Homo sapiens
MSEMAELSELYEESSDLQMDVMPGEGDLPQMEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAALEEADKMFLRTREPALDGGFQMHYEKTPFDQLAFIEELFSLMVVNRLTEELGCDEIIDRE

SEQ ID NO: 1008 - DNA, 3058 bp, Homo sapiens
gacagcaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatggcgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagattttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaaaaaaaaaaaaaaaaaaaaaaaaaaaaaaaaaaaaaaaaaaaaaaaaaaaaagaaaaaaaaaaaaaaaaa

SEQ ID NO: 1009 - protein, 243 aa, Homo sapiens
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYGEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 1010 - DNA, 2359 bp, Homo sapiens
cgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcactttttttttttttttttttttttaaa

SEQ ID NO: 1011 - protein, 187 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 1012 - DNA, 2180 bp, Homo sapiens
ggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccaggaaaaaaaaaaaaaaaaaaaaaaa

SEQ ID NO: 1013 - protein, 90 aa, Homo sapiens
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 1014 - DNA, 1102 bp, Homo sapiens
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaaaaaaaaaaaaaaa

SEQ ID NO: 1015 - protein, 104 aa, Homo sapiens
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 1016 - DNA, 5230 bp, Homo sapiens
atcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgaaaaaaaaaaaaaaaa

SEQ ID NO: 1017 - protein, 250 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 1018 - DNA, 1147 bp, Homo sapiens
aggcggcaggaggcgggtgggtcaaggtaactctgggctacagagtccttgctgggggttcggggagcgcttggaccccggcttctgggacgcgtcaggagaagggagcactggctttgctttcatcaggccaaagatgcctttctttgggaatacgttcagtccgaagaagacacctcctcggaagtcggcatctctctccaacctgcattctttggatcgatcaacccgggaggtggagctgggcttggaatacggatccccgactatgaacctggcagggcaaagcctgaagtttgaaaatggccagtggatagcagagacaggggttagtggcggtgtggaccggagggaggttcagcgccttcgcaggcggaaccagcagttggaggaagagaacaatctcttgcggctgaaagtggacatcttattagacatgctttcagagtccactgctgaatcccacttaatggagaaggaactggatgaactgaggatcagccggaagagaaaatgaagaccccagagacatttattggggagtaggatgtggctgagtgctttttttttggccagactagcggattcagtcctggaagagagtatcatataatgagacccacaggcactggcacccttgggttggcaatagaaggtgacatggaatggagaaaaccaagattccagatggggatagtaactagaaggtgcttcagatgcactgcctgcgggtgccagtctgaaaaccagaccgcacagaggcctggggctgctgatgagctttttggtgctctccacacacaagctcgcaaacacacatgtcccagaatagctctgttgggttgtgttgggagaagcggctggagttcattctctcacccccttatgttggtgtttggcgtgtgacagcagttctacagagctctgtgttggggtcatggatgagcggctctcttggctcttaaaggcaggcctctctcttcttgcctttaaagaatcctccttcctcacacctggcctcctctggcttcagcttctcagcagcaagcaccagccttccacaacaacactatatttttatgctactttcctgtttgcactactacttttttattaaacgatgttaaataaaaaaaaaaaaaaaaaa

SEQ ID NO: 1019 - protein, 126 aa, Homo sapiens
MPFFGNTFSPKKTPPRKSASLSNLHSLDRSTREVELGLEYGSPTMNLAGQSLKFENGQWIAETGVSGGVDRREVQRLRRRNQQLEEENNLLRLKVDILLDMLSESTAESHLMEKELDELRISRKRK

SEQ ID NO: 1020 - DNA, 749 bp, Homo sapiens
gacaagcgctgcggcatttgtccccgcgacagcaccgctgccgccgtctctaaggtcgcccgggtcccaccgccgccaccatgcctcggggaagccgcagcgcggcctcccggccagccagccgcccagccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccacaaaaaaaaaaaaaaaaaaaaaaaaaaaaaaaaaaaaaaaaaaaaaaaaaaaaaaaaaaaaaaaaaaaa

SEQ ID NO: 1021 - protein, 142 aa, Homo sapiens
MPRGSRSAASRPASRPAAPSAHPPAHPPPSAAAPAPAPSGQPGLMAQMATTAAGVAVGSAVGHVMGSALTGAFSGGSSEPSQPAVQQAPTPAAPQPLQMGPCAYEIRQFLDCSTTQSDLSLCEGFSEALKQCKYYHGLSSLP

SEQ ID NO: 1022 - DNA, 2110 bp, Homo sapiens
gaacccggtctcccgcaagatggagccgggttgggctgtgacgctgctgctggggtcagaatgtcatacccaggctatcccccaacaggctacccacctttccctggatatcctcctgcaggtcaggagtcatcttttcccccttctggtcagtatccttatcctagtggctttcctccaatgggaggaggtgcctacccacaagtgccaagtagtggctacccaggagctggaggctaccctgcgcctggaggttatccagcccctggaggctatcctggtgccccacagccagggggagctccatcctatcccggagttcctccaggccaaggatttggagtcccaccaggtggagcaggcttttctgggtatccacagccaccttcacagtcttatggaggtggtccagcacaggttccactacctggtggctttcctggaggacagatgccttctcagtatcctggaggacaacctacttaccctagtcagcctgccacagtgactcaggtcactcaaggaactatccgaccagctgccaacttcgatgctataagagatgcagaaattcttcgtaaggcaatgaagggttttgggacagatgagcaggcaattgtggatgtggtggccaaccgttccaatgatcagaggcaaaaaattaaagcagcatttaagacctcctatggcaaggatttaatcaaagatctcaaatcagagttaagtggaaatatggaagaactgatcctggccctcttcatgcctcctacgtattacgatgcctggagcttacggaaagcaatgcagggagcaggaactcaggaacgtgtattgattgagattttgtgcacaagaacaaatcaggaaatccgagaaattgtcagatgttatcagtcagaatttggacgagaccttgaaaaggacattaggtcagatacatcaggacattttgaacgtttacttgtgtccatgtgccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaagcagtgtgagccgtgagttttccggatatgtagaaagtggtttgaagaccatcttgcagtgtgccctgaaccgccctgccttctttgctgagaggctctactatgctatgaaaggtgctggcacagatgactccaccctggtccggattgtggtcactcgaagtgagattgaccttgtacaaataaaacagatgttcgctcagatgtatcagaagactctgggcacaatgattgcaggtgacacgagtggagattaccgaagacttcttctggctattgtgggccagtaggagggatttttttttttttaatgaaaaaaaaatttctattcatagcttatccttcagagcaatgacctgcatgcagcaatatcaaacatcagctaaccgaaagagctttctgtcaaggaccgtatcagggtaatgtgcttggtttgcacatgttgttattgccttaattctaattttattttgttctctacatacaatcaatgtaaagccatatcacaatgatacagtaatattgcaatgtttgtaaaccttcattcttactagtttcattctaatcaagatgtcaaattgaataaaaatcacagcaatctctgattctgtgtaataatattgaataattttttagaaggttactgaaagctctgccttccggaatccctctaagtctgcttgatagagtggatagtatgttaaaactgtgtactttaaaaaaaaattcaacctttacatctagaataatttgcatctcattttgcctaaattggttctgtattcataaacactttccacatagaaaatagattagtattacctgtggcaccttttaagaaagggtcaaatgtttatatgcttaagatacatagcctccctttttttcgcgttgtttcctttttttaaattgagttatgacaaataaaaaattgcatat

SEQ ID NO: 1023 - protein, 466 aa, Homo sapiens
MSYPGYPPTGYPPFPGYPPAGQESSFPPSGQYPYPSGFPPMGGGAYPQVPSSGYPGAGGYPAPGGYPAPGGYPGAPQPGGAPSYPGVPPGQGFGVPPGGAGFSGYPQPPSQSYGGGPAQVPLPGGFPGGQMPSQYPGGQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEILCTRTNQEIREIVRCYQSEFGRDLEKDIRSDTSGHFERLLVSMCQGNRDENQSINHQMAQEDAQRLYQAGEGRLGTDESCFNMILATRSFPQLRATMEAYSRMANRDLLSSVSREFSGYVESGLKTILQCALNRPAFFAERLYYAMKGAGTDDSTLVRIVVTRSEIDLVQIKQMFAQMYQKTLGTMIAGDTSGDYRRLLLAIVGQ

SEQ ID NO: 1024 - DNA, 368 bp, Homo sapiens
ctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcct

SEQ ID NO: 1025 - protein, 70 aa, Homo sapiens [sequence omitted]

SEQ ID NO: 1026 - DNA, 1571 bp, Homo sapiens
aataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttcaaaaaaaaaaaaaaaaaaa

SEQ ID NO: 1027 - protein, 252 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 1028 - DNA, 6182 bp, Homo sapiens
ggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagtcttgctctgtcaccctagctggagtgcagtggcgtgatcttggtttactgcaacctctgcctcccaagttcaagcgattctcctgcctcagcttcccaagtagctgggactacagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaaaaaaaaaaaaaaaa

SEQ ID NO: 1029 - protein, 77 aa, Homo sapiens
MAGAIASRMSFSSLKRKQPKTFTVRIVTMDAEMEFNCESCSVTLAGVQWRDLGLLQPLPPKFKRFSCLSFPSSWDYR

SEQ ID NO: 1030 - DNA, 623 bp, Homo sapiens
aggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctccaaaaaaaaaaaaaaaaaaaaaaaaaaaa

SEQ ID NO: 1031 - protein, 117 aa, Homo sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 1032 - DNA, 3378 bp, Homo sapiens
acagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaaaaaaaaaaaaaaaaa

SEQ ID NO: 1033 - protein, 323 aa, Homo sapiens
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 1034 - DNA, 1693 bp, Homo sapiens
agcggggctgcgcgaagtcatcgctgttccagacagcgatgactcgagagcggtgggggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaatatttccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattaggcctgtgcaaaaccatctgtttggggagcacactctt

SEQ ID NO: 1035 - protein, 82 aa, Homo sapiens
MNRPAPVEISYENMRFLITHNPTNATLNKFTEELKKYGVTTLVRVCDATYDKAPVEKEGIHVLKKKGSVQFQTAALFGEIPT

SEQ ID NO: 1036 - DNA, 1126 bp, Homo sapiens
agccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgcgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattaaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattag

SEQ ID NO: 1037 - protein, 261 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGAFCAGADLKEREQMSEAEVGVFVQRLRGLMNDIASSAVMGLIETTRGLLPGAGGTQRLPRCLGVALAKELIFTGRRLSGTEAHVLGLVNHAVAQNEEGDAAYQRARALAQEILPQAPIAVRLGKVAINRGTEVDIASGMAIEGMCYAQNIPTRDRLEGMAAFREKRTPKFVGK

SEQ ID NO: 1038 - DNA, 1425 bp, Homo sapiens
gcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacgaagacgagatgtcacagaggtccactcagtgacaaacacacactgaaggcctgagggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaaaa

SEQ ID NO: 1039 - protein, 200 aa, Homo sapiens
MFRKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 1040 - DNA, 1929 bp, Homo sapiens
gggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtgaaaaaaaaaaaaaaaaaaaa

SEQ ID NO: 1041 - protein, 60 aa, Homo sapiens
MAVTALAARTWLGVWGVRTMQARGFGSDQSENVDRGAGSIREAGGAFGKREQAEEERYFR

SEQ ID NO: 1042 - DNA, 1938 bp, Homo sapiens
gactttggtggcaagaggagctggcggagcccagccagtgggcggggccaggggaggggcgggcaggtaggtgcagccactcctgggaggaccctgcgtggccagacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcac

SEQ ID NO: 1043 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 1044 - DNA, 556 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgattttgaaaaacaaaaaaaaaaaaa

SEQ ID NO: 1045 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 1046 - DNA, 2348 bp, Homo sapiens
aggtggagccttttttgctcacggcagcaagttcccttctcctttctctcccccggcggcgtgtgcattggctcttcaagctgcctgtgctgctccgtggagtgaaaaaggcagggtgtgctcgcagactgtgctataaactgcaatttctatttggggtcctcacggagaagaacaccaggaaagacagacaggaccagtgccatgggccagctttgctgctttcctttctcaagagatgaaggaaaaatcagtgagttggaaagctcgtcctctgcagtcctacagagatacagcaaggatatacccagttggtcaagtggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgaaaaaaaaaaaaaaaaaaaaaa

SEQ ID NO: 1047 - protein, 104 aa, Homo sapiens
MGQLCCFPFSRDEGKISELESSSSAVLQRYSKDIPSWSSGEKNGGEPDDAELVRLSKRLVENAVLKAVQQYLEETQNKNKPGEGSSVKTEAADQNGNDNENNRK

SEQ ID NO: 1048 - DNA, 2758 bp, Homo sapiens
gaattcaggggggaaaggaggagctggagacagattgtaggaccgagcgcgggcaggcgggaggcaacggagctaccagccgctcctctctgctatatgaaatatgggagacgacagaccgtttgtgtgcaatgccccgggctgtggacagagatttacaaacgaggaccacctggcagttcataaacacaagcatgagatgacattgaaatttggcccagcccgaactgactcagtcatcattgcagatcaaacgcctactccaactagattcctgaagaactgtgaggaggtgggactcttcaatgaactagctagctcctttgaacatgaattcaagaaagctgcagatgaggatgagaaaaaggctgctgctgggccccttgacatgtctctgccttccacaccagacatcaaaatcaaagaagaagagccagtggaggtagactcatccccacctgatagccctgcctctagtccctgttccccaccactgaaggagaaggaggttaccccaaagcctgttctgatctctacccccacacccaccattgtacgtcctggctccctgcctctccacttgggctatgatccacttcatccaacccttccctccccaacctctgtcatcacacaggctccaccatccaacaggcaaatggggtctcccactggctccctccctcttgtcatgcatcttgctaatggacagaccatgcctgtgttgccagggcctccagtacagatgccgtctgttatatcgctggccagacctgtgtccatggtgcccaacattcctggtatccctggcccaccagttaacagtagtggctccatttctccctctggccaccctataccatcagaagccaagatgagactgaaagccaccctaactcaccaagtctcctcaatcaatggtggttgtggaatggtggtgggtactgccagcaccatggtgacagcccgcccagagcagagccagattctcatccagcaccctgatgccccatcccctgcccagccacaggtctcaccagctcagcccacccctagtactggggggcgacggcggcgcacagtagatgaagatccagatgagcgacggcagcgctttctggagcgcaaccgggctgcagcctcccgctgccgccaaaagcgaaagctgtgggtgtcctccctagagaagaaggccgaagaactcacttctcagaacattcagctgagtaatgaagtcacattactacgcaatgaggtggcccagttgaaacagctactgttagctcataaagactgcccagtcactgcactacagaaaaagactcaaggctatttagaaagccccaaggaaagctcagagccaacgggttctccagcccctgtgattcagcacagctcagcaacagcccctagcaatggcctcagtgttcgctctgcagctgaagctgtggccacctcggtcctcactcagatggccagccaaaggacagaactgagcatgccgatacaatcgcatgtaatcatgaccccacagtcccagtctgcgggcagatgatgcctcctctggtggagaggtcctcagccagagctcgcccgcccaagagccaagagagatgtcatcttatcccctcccatctgccttggacatggcaatatgggtggggggaattgtgtgttgtgagtaatggacagatatggggctttttagccatgtggtcatgtacgtttgacacctgtgctgggggcctcccagccccggagcctcatagatcatcccccagggtggggtttctgatgcatccacagccaaaggcctttccagatggtccgaacaatcacccctgccccatgcacgtgtatctgtctcttttaacactaacccttggcacttctaggtttggggtttctcagttccctctcttcccactaagccgtggctgttacctttttgttccttaccagcatgccacttcctgccagatagagggaggctagatttgatgacatattacccgctgacccagccccagccaccccatggactcaggactcaggtctcccatagctgcttatttacccgtttcctttttcctcttccttaattctagttaaaacattcacttacggagaatgtaaggttacctttgatgtatgaagtagcagtattttccagtttttccataagctttattccttctctctacctgccaccaaaaagaaagaaaccctcaagagttctaattctttttcatctatttgcacagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattggggtatcaacattaccgcccctgtctctcttcattcccctatcaacattaccgcccctgtctcttctgtaactacttcagactcagccctcctggaggctgtcatgtaggggactctcgaggttcctttgttctaccccatctctcccccccgaattc

SEQ ID NO: 1049 - protein, 483 aa, Homo sapiens
MGDDRPFVCNAPGCGQRFTNEDHLAVHKHKHEMTLKFGPARTDSVIIADQTPTPTRFLKNCEEVGLFNELASSFEHEFKKAADEDEKKAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 1050 - DNA, 6091 bp, Homo sapiens
ggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccggccagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaaaaaaaaaaaaaaaa

SEQ ID NO: 1051 - protein, 92 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVGLELDETGTGS

SEQ ID NO: 1052 - DNA, 4160 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttgtcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaaaaaaaaaaaaa

SEQ ID NO: 1053 - protein, 440 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 1054 - DNA, 1089 bp, Homo sapiens
ccacgcgtccgcccacgcgtccgcgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagaggtaaaaatacaatagctgggccaaggggaagttttcaggacagctcattgcatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtggggtctctggcccctcagggacttgagattatttaagtactagttcctaacacgttctggaaaataaaaataactctgggttaaaaaaaaaaaaaaaaaaaaa

SEQ ID NO: 1055 - protein, 140 aa, Homo sapiens
MGSEAAQLLEAADFAARKHRQQRRKDPEGTPYINHPIGVARILTHEAGITDIVVLQAALLHDTVEDTDTTLDEVELHFGAQVRRLVEEVTDDKTLPKLERKRLQVEQAPHSSPGAKLVKLADKLYNLRDLNRCTPEVKIQ

SEQ ID NO: 1056 - DNA, 4063 bp, Homo sapiens
gtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgctctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacagacttggtgtgtgtccttccctggggggacgggggactcacatgtgcctgccactggagcctctcaaccgtccagcagaacacggggttcagaaagggctccttctgctatttagcgaacactgagcatttaatttacaaatgtttgctagggtcaccctctcggccatcccacgagggtcgccatgatcaccccaactctagaggccgcagcagagctcaggacattcccccacagagcttgcccctcagttcctacctccaagggggagggtcctggaagcgcccacccaggcgccgcccctgtgcttgctccccgagctcagggattgccgagtccacgtaactgacctgtactccacgaggccctgtgggaacggtccaggctggtcctgccctgtggaggcctccgtgcactgagagatgtactaggattgcagcaaaggtggtcagggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggatcacttgaacctgggaggcggaggttgcagtgagctgagattgcgccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaaaaaaaaaaaaaaa

SEQ ID NO: 1057 - protein, 148 aa, Homo sapiens
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 1058 - DNA, 778 bp, Homo sapiens
gagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 1059 - protein, 208 aa, Homo sapiens
MPPKKDVPVKKPAGPSISKPAAKPAAAGAPPAKTKAEPAVPQAPQKTQEPPVDLSKVVIEFNKDQLEEFKEAFELFDRVGDGKILYSQCGDVMRALGQNPTNAEVLKVLGNPKSDELKSRRVDFETFLPMLQAVAKNRGQGTYEDYLEGFRVFDKEGNGKVMGAELRHVLTTLGEKMTEEEVETVLAGHEDSNGCINYEAFLKHILSV

SEQ ID NO: 1060 - DNA, 3249 bp, Homo sapiens
gcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgaaaaaaaaaaaaaaaaaaaaaaaaaaaaaaaa

SEQ ID NO: 1061 - protein, 690 aa, Homo sapiens
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 1062 - DNA, 568 bp, Homo sapiens
gaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaa

SEQ ID NO: 1063 - protein, 160 aa, Homo sapiens [sequence omitted]

SEQ ID NO: 1064 - DNA, 2184 bp, Homo sapiens
ggccctcgcggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctccagagacaagtccaagttcttgatccacccattccccctataatggcagaggacctttatgtctcttttctctcccttatacccttggatcacagctccagttgtccccagagcaccctgggcctgggctgagccagaccagacccttgggaggtggccctatccctaggcagtggtgctaggaggacagaaggctatatgggcgtggcagaggctggttaacaagggcttagtacacgcttgctgttctgtgcccagtatgtgggcggatgacgcaagactacaagatccttgccctcaagctgctaggaacttacggttttattaggagagcagtacaagggtatctatcccagtaccaaatggtgcttcagctctaacatggaggtcagagaaagggacttggaccaataaaatgacatggaggcctaacaggttgcctgaatgagagtcacagtcacctggaagaaagtatccagacccaacctgttagctaccctcaccagcaccaaatcttcccttctcagacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaagaaaaaaaaaaa

SEQ ID NO: 1065 - protein, 279 aa, Homo sapiens
MTPSEGARAGTGRELEMLDSLLALGGLVLLRDSVEWEGRSLLKALVKKSALCGEQVHILGCEVSEEEFREGFDSDINNRLVYHDFFRDPLNWSKTEEAFPGGPLGALRAMCKRTDPVPVTIALDSLSWLLLRLPCTTLCQVLHAVSHQDSCPGDSSSVGKVSVLGLLHEELHGPGPVGALSSLAQTEVTLGGTMGQASAHILCRRPRQRPTDQTQWFSILPDFSLDLQEGPSVESQPYSDPHIPPVSKNAKARTRKCSLVSGHGRENKSCRGWGWGQGF

SEQ ID NO: 1066 - DNA, 2504 bp, Homo sapiens
gcgatctagacctagttagccaagtctctaacgtgacatagggaaagcttgcaatggcaactggccgcccgtctgcgcctgtctctcgccacgcctattgctgcaggatgacgcgcacctctatgaacccgccgtgaggtgtgagtgtgacgcagggaagagtcgcacggacgcactcgcgctgcggccagctgcgggcccgggcggcggctgtgttgcgcagtcttcatgggttcccgacgaggaggtctctgtggctgcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcc

SEQ ID NO: 1067 - protein, 550 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 1068 - DNA, 1881 bp, Homo sapiens
gcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagt

SEQ ID NO: 1069 - protein, 554 aa, Homo sapiens
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 1070 - DNA, 1196 bp, Homo sapiens
atcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcctgaaaattcttcttgaccttgacagtcaccttgaaggatttcgcaagtccagaaattgaggactctggatttttgtcaactaactctgtgaacatagccatcagatttgatgaggaacttaggagagaggagttttatttcctccttcgatgttttcctctcagttgtaaaagatgaactctttgagatgatttctcacctgctgtggtatcttgcaggaactgtgtgctaaaattgaacaatttttttgagattatggttgcaatacttggcgtggaatcagctttacataaatataccttgtatgcaaacgatgataaactagtcaggatgagcagagctgcctgacctcttgatttctgctgcaaaagacatatacactgtactggggtcactatttatgaaagcaattggttaggacctctttttttcctctcagggaactaatgctctgaaaagggatctgggcacaacagtttcagtgagtgcttttgagcacacttttatttttatatagtaactaatggttaagattgatggtggcctggattagcaaagaggaagacagcttttaacacagttccctgccttcacaagaggtgtcagattaagatgtgaaagctgcaagaatgttgcagtgaacaccatttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaagatggaataaattgtaacatttagtttctatcattaaaaaaaaaaaaaaa

SEQ ID NO: 1071 - protein, 76 aa, Homo sapiens
MNSVGEACTDMKREYDQCFNRWFAEKFLKGDSSGDPCTDLFKRYQQCVQKAIKEKEIPIEGLEFMGHGKEKPENSS

SEQ ID NO: 1072 - DNA, 3332 bp, Homo sapiens
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaa

SEQ ID NO: 1073 - protein, 162 aa, Homo sapiens
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 1074 - DNA, 1596 bp, Homo sapiens
ccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttaaaaaaaaaaataaagggatatggctgttgtagaaagatagcgtatttgcatttacaataacagtagcatgttgtcagtggccaaggctacacagaaggctccctgctgcccggagcaggtacatccacagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcaatgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaaaaaaaaaaaaaaaaaa

SEQ ID NO: 1075 - protein, 241 aa, Homo sapiens
MRTADGGEPAGASSPAGRVDGGLQMGSERMEMRKRQMPAAQDTPGAAPGQPGAGSRGSNACCFCWCCCCSCSCLTVRNQEDQRPTIASHELRADLPTWEESPAPTLEEVNAWAQSFDKLMVTPAGRNAFREFLRTEFSEENMLFWMACEELKKEANKNIIEEKARIIYEDYISILSPKEVSLDSRVREVINRNMVEPSQHIFDDAQLQIYTLMHRDSYPRFMNSAVYKDLLQSLSEKSIEA

SEQ ID NO: 1076 - DNA, 3505 bp, Homo sapiens
cgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttaaaaa

SEQ ID NO: 1077 - protein, 219 aa, Homo sapiens
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 1078 - DNA, 1427 bp, Homo sapiens
attaacccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataaaaaaaaaaaa

SEQ ID NO: 1079 - protein, 257 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQLAWDQWQGPRNLKVLTKMTCCC

SEQ ID NO: 1080 - DNA, 1143 bp, Homo sapiens
ggagctctggaggcggggcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcccaaaaaaaaaaaaaaaaaaaaaaaaa

SEQ ID NO: 1081 - protein, 170 aa, Homo sapiens
MSVAGGEIRGDTGGEDTAAPGRFSFSPEPTLEDIRRLHAEFAAERDWEQFHQPRNLLLALVGEVGELAELFQWKTDGEPGPQGWSPRERAALQEELSDVLIYLVALAARCRVDLPLAVLSKMDINRRRYPAHLARSSSRKYTELPHGAISEDQAVGPADIPCDSTGQTST

SEQ ID NO: 1082 - DNA, 2447 bp, Homo sapiens
cccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggtcaaagtttagggtacagttggctaggtatcattcaactctccaatgttctattaatcacctctctgtagtttatggtcagaagggaattgctcagagaaggtaaaagactgaatctacctgcctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaattttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattccaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacatatccacaatagctgacggctgggtgtttcagtttgcaaaatattttgttgccttcatcttcactgcaattttgtgtaaatttctcaaagatctaattaaataaataaaattcatttctacagactca

SEQ ID NO: 1083 - protein, 274 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 1084 - DNA, 1434 bp, Homo sapiens
gagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaaaaaaaaaaaaaaaaaaaaaaaaaaaaaaaaaaaaaaaaaaa

SEQ ID NO: 1085 - protein, 245 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 1086 - DNA, 1234 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtgaaaaaaaaaaaa

SEQ ID NO: 1087 - protein, 149 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 1088 - DNA, 600 bp, Homo sapiens
gagggtccgcggttggtcagaccggggcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcaaaaaaaaaaaaaa

SEQ ID NO: 1089 - protein, 99 aa, Homo sapiens
MAAAAASRGVGAKLGLREIRIHLCQRSPGSQGVRDFIEKRYVELKKANPDLPILIRECSDVQPKLWARYAFGQETNVPLNNFSADQVTRALENVLSGKA

SEQ ID NO: 1090 - DNA, 1782 bp, Homo sapiens
acttccgctgctgtttcgtagccgactgctgaaggctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtcaaaaaaaaaaaaaaaaaaaaaa

SEQ ID NO: 1091 - protein, 219 aa, Homo sapiens
MEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 1092 - DNA, 1290 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttggaaaaaaaaaaaaaaaaaaaaaaaaaaaaaa

SEQ ID NO: 1093 - protein, 322 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGGSRGQVTALVSLKAGLIQSRSTLSDFQGTFMTVGIALS

SEQ ID NO: 1094 - DNA, 659 bp, Homo sapiens
acaaagggccggaaggaagccggggagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatcaaaactgcacatccacagagcagagatctcaaagattatgcgagaatgtcaggaagaaagtttctggaagagagctctgcctttttctcttgtaagcatgcttgtcacccagggactagtctaccaaggttatttggcagctaattctagatttggatcattgcccaaagttgcacgcactgcctccttacctgtgaggaatgcaaaataaagcatggattaagtgagaagggagactctcagccttcagcttcctaaattctgtgtctgtgactttcgaagttttttaaacctctgaatttgtacacatttaaaatttcaagtgtactttaaaataaaatacttctaatggaaaaaaaaaaaaaaa

SEQ ID NO: 1095 - protein, 99 aa, Homo sapiens
MASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 1096 - DNA, 1433 bp, Homo sapiens
ctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattacaggcacgcaccaccatacctggctaatttttgtattttgagtagagatggagttttcaccacattggccaggctgttcttgaactgacctcaagcgatccacctgccttggccttccagagtgctgggattacaggtgtgagccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacaaaaaatagcttggtatggtggcacatgcctgtaatcccagctactttggaggctcaggcacaagaatcacttgaacctacgaggcggaggttgcagtgggccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatg

SEQ ID NO: 1097 - protein, 92 aa, Homo sapiens [sequence omitted]

SEQ ID NO: 1098 - DNA, 1268 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtcgtaatttaaagaactcaataaaaacttctattttttattttaaaataataccaaaaaaaaaaaaaaaaaaaaaaaaaaaaaa

SEQ ID NO: 1099 - protein, 314 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 1100 - DNA, 3175 bp, Homo sapiens
cccgatgcctcctctcccttcaacgcttctgctgctgctcgctgcttgatgatggcggccagtattttaaaaaatagcaaaattattcatcggcttctttccctcccgtgcctctgcgtgtgtgcgagtgtgtgtgcgtgcgtgtgtgcgtgtctgggcgcgcgtgttccagcgctgtgcgagcgggcgggcggcgagtgcgtgtgagtggtgtgtgtgtgtgcgtgtgcaatcgttacacgctttcgcctcgctccagcttttaccccagcagcgcgattcccccggttctcctgctgccgctgctgcgccgctgccgccgtggctcgcgcggctcggggcgggcacgggctgcgtaggagccgccgccggggccgccgctggggccgcgctgccgcagccgctgcgccgccgcctagactactagcctgggctgcttgttttgtctctgaaattgacaaggacgcagggaatccgctgctaaataatgtttctgtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatggctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaaggtgttaagtcacaaaaagcggtaataaatatttcatttttgaaaaaaaaaaaaaaaaaaaaaaaaaaaaaaaaaaaaaaaaaaaaaaaaaaaaaaaaaaaaaaaa

SEQ ID NO: 1101 - protein, 306 aa, Homo sapiens
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 1102 - DNA, 1011 bp, Homo sapiens
cggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggccagagactgctgctactttgaaacgtacgatagaggccctgatggacagaggagcaatagtgagggacttggaaaacctgggtgaacgagcgcttccttataggatctctgcccacagtcagcagcacaacagaggcgggtatttcttggtggatttttatgcacccaccgcagctgttgaaagcatggtggagcacttgtctcgagatatagatgtgattagagggaatattgtcaaacaccctctgacccaggaactaaaagaatgtgaagggattgtcccagtcccactcgcagaaaaattatattccacaaagaagaggaagaagtgagaagattcgccagattttagccttatatgtaattccttcacatttgggcagcatggacgagaaggaagaatttgcaagtttggcctttatataagcatgtgttgcaggtgctgtttgatttttctaaggtatttttagcccttgatcccctttgcttgcgagaggtggggaactgctcactgacagcttctctgtaacctgcagtaccagtggatcattcttgattttgttttcattagtgtcatttctttgtcattgaggacttttccccttacaacagtaacaccattttttgaagagcaaaacttataatacctcctgggattgtgagctagtcattcagcctgtgtaaccatgtggaaataaaaattgacgaccaatgtattatatggacaacttttgctttgagtaataaacttgattgtaggaaaaaaaaaaaaaaaaaaaaaaaaaaa

SEQ ID NO: 1103 - protein, 125 aa, Homo sapiens
MPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 1104 - DNA, 1255 bp, Homo sapiens
gccggaagtgggttgacgtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaactttttttttttttttttacctcctgtcttgccccctaaaagaaataaatagagcaaacatctcgaaaaaaaaaaaaaaaaa

SEQ ID NO: 1105 - protein, 101 aa, Homo sapiens
MVCEKCEKKLGTVITPDTWKDGARNTTESGGRKLNENKALTSKKARFDPYGKNKFSTCRICKSSVHQPGSHYCQGCAYKKGICAMCGKKVLDTKNYKQTSV

SEQ ID NO: 1106 - DNA, 1366 bp, Homo sapiens
acttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcctaaaaaaaaaaaaaaaaaaaaaa

SEQ ID NO: 1107 - protein, 195 aa, Homo sapiens
MAALKSWLSRSVTSFFRYRQCLCVPVVANFKKRCFSELIRPWHKTVTIGFGVTLCAVPIAQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 1108 - DNA, 1345 bp, Homo sapiens
acttggccttacactccgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggtctctctaccctcgagtggtgagtatcgccgaagtgggcattcgcggtgtgcgctgccctggagtcactggggaacgacccgactccagagcctcgacctgacctgtctcctgttttgtctccccttagtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctgggctaggccggtgggaaggagagcgtcgttaatttatttcttattgctcctaattaatatttatatgtatttatgtacgtcctcctaggtgatggagatgtgtacgtaatatttattttaacttatgcaagggtgtgagatgttccctctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 1109 - protein, 193 aa, Homo sapiens
MCHSRSCHPTMTILQAPTPAPSTIPGPRRGSGPEIFTFDPLPEPAAAPAGRPSASRGHRKRSRRVSLPSSGEYRRSGHSRCALPWSHWGTTRLQSLDLTCLLFCLPLVRRQLPVEEPNPAKRLLFLLLTIVFCQILMAEEGVPAPLPPEDAPNAASLAPTPVSPVLEPFNLTSEPSDYALDLSTFLQQHPAAF

SEQ ID NO: 1110 - DNA, 1278 bp, Homo sapiens
gcttcgcggcggaggcccgggcaactcttttgaatggaatcgggctgattcatcgccggtttgcagacagagccgcgtcgggtgtgcgccgctgctgctgttgcctctgtcttcgcgtcaccacagaggcaagacaagggtccatatcgcggcatccggctcccgcccgtcttcaggagagaaagaaaaaataaaatatacttggggaagttgtacctgccagaattagcaagagctttctttaagaagacatttgtcaaactcaacaaattgaaggttaacaccttaagagttgtagttactgaccagaaatatggacagacttcttagacttggaggaggtatgcctggactgggccaggggccacctacagatgctcctgcagtggacacagcagaacaagtctatatctcttccctggcactgttaaaaatgttaaaacatggccgtgctggagttccaatggaagttatgggtttgatgcttggagaatttgttgatgattataccgtcagagtgattgatgtgtttgctatgccacagtcaggaacaggtgtcagtgtggaggcagttgatccagtgttccaagctaaaatgttggatatgttgaagcagacaggaaggccggagatggttgttggttggtatcacagtcaccctggctttggttgttggctttctggtgtggatatcaacactcagcagagctttgaagccttgtcggagagagctgtggcagtggttgtggatcccattcagagtgtaaaaggaaaggttgttattgatgccttcagattgatcaatgctaatatgatggtcttaggacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttggatggaaggtttgacacttcaggactacagtgaacattgtaaacacaatgaatcagtggtaaaggagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgccaaaaaaaaaaaaaaaa

SEQ ID NO: 1111 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 1112 - DNA, 423 bp, Homo sapiens
ctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaaaaaaaaaaa

SEQ ID NO: 1113 - protein, 83 aa, Homo sapiens
MAELGEADEAELQRLVAAEQQKAQFTAQVHHFMELCWDKCVEKPGNRLDSRTENCLSSCVDRFIDTTLAITSRFAQIVQKGGQ

SEQ ID NO: 1114 - DNA, 2411 bp, Homo sapiens
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgttaaaaaaaaaaaaaaaa

SEQ ID NO: 1115 - protein, 275 aa, Homo sapiens
MASFPPRVNEKEIGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 1116 - DNA, 1450 bp, Homo sapiens
gccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagcgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaaaaaaa

SEQ ID NO: 1117 - protein, 396 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 1118 - DNA, 1807 bp, Homo sapiens
gcacgagggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggcccccggagccatggggtgtcgggggctcctgtgcaggctcatgctgcaggcggccgaggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatggtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcac

SEQ ID NO: 1119 - protein, 331 aa, Homo sapiens
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 1120 - DNA, 2636 bp, Homo sapiens
tggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaaaaaaaaaaaaaaaaaaa

SEQ ID NO: 1121 - protein, 293 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 1122 - DNA, 1232 bp, Homo sapiens
tttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggactgcgatggcttctccaccttcgatgttcccatcttcactgaagagttcttggaccaaaacaaagcgcgtgaggcggagcttcggcgcttgcggaagatgaatgtggccttcgaggagcagaacgcggtactgcagaggcaaaacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggcacgggcgaaacgcccacgctgggcactctggacttctacatggcccggcttcacggagccatcgagcgcgaccccgcccagcacgagaagctcatcgtccgcatcaaggaaatcctggcccaggtcgccagcgagcacctgtgaggagtgggcgggcccacgatgcagaggagaagctgtgggcgcggccctgccacaccccaccccgtggacgagaggctgggggtccaccctttggggcctggtcccatcctgcacctttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaaaa

SEQ ID NO: 1123 - protein, 341 aa, Homo sapiens
MLGAEWSKLQPTEKQRYLDEAEREKQQYMKELRAYQQSEAYKMCTEKIQEKKIKKEDSSSGLMNTLLNGHKGGDCDGFSTFDVPIFTEEFLDQNKAREAELRRLRKMNVAFEEQNAVLQRQNAEHEQRARASGAGAGAGGAEDAGAAAAAPGRAPGAHRQLRLTAGAGHGRNAHAGHSGLLHGPASRSHRARPRPAREAHRPHQGNPGPGRQRAPVRSGRAHDAEEKLWARPCHTPPRGREAGGPPFGAWSHPAPLGAPAPLKLNFCSIPLAFNLPSPLNPEKALAARYTQKNLTAEGAPPRRTATRYTGSPGHPQDTGQTKPTPSTRQDPPNYSLRGAVP

SEQ ID NO: 1124 - DNA, 1279 bp, Homo sapiens
gcggccgcgtcgacatgcagtgtgcctaaaacctgccagcagtacttttgagtttttttttttgttttgttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcacagaatatgatgtaataacttctatttattgatcatttattgatcatgtattcagataaatgtatatgtatcatgaatttttatggattaatatattgaatactttcattgacgttaaataagaatattaagattttaaatgttaccctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagccttt

SEQ ID NO: 1125 - protein, 210 aa, Homo sapiens
MAEDKETKHGGHKNGRKGGLSGTSFFTWFMVIALLGVWTSVAVVWFDLVDYEEVLGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 1126 - DNA, 1093 bp, Homo sapiens
ggctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccaattgc

SEQ ID NO: 1127 - protein, 183 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 1128 - DNA, 1151 bp, Homo sapiens
ctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgttttttttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaaaaaaaaaaaaaaaaaaaaaaaaaaaa

SEQ ID NO: 1129 - protein, 165 aa, Homo sapiens
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 1130 - DNA, 958 bp, Homo sapiens
ggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggagtgagtggctgcagcctcaggaccctgaggggtttcccagccccgtgcggtgggtcccagcctgagggtggagtcctgcccactctgggagcctcacgctgagggaggagtcaggctgtcccagcgaggcccgacggcctc

SEQ ID NO: 1131 - protein, 178 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPE

SEQ ID NO: 1132 - DNA, 725 bp, Homo sapiens
ggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccaaaa

SEQ ID NO: 1133 - protein, 204 aa, Homo sapiens [sequence omitted]

SEQ ID NO: 1134 - DNA, 650 bp, Homo sapiens
agcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagttaaaaaaaaaaagaaaaaaaaaaaaaaa

SEQ ID NO: 1135 - protein, 169 aa, Homo sapiens
MGWSQDLFRALWRSLSREVKEHVGTDQFGNKYYYIPQYKNWRGQTIREKRIVEAANKKEVDYEAGDIPTEWEAWIRRTRKTPPTMEEILKNEKHREEIKIKSQDFYEKEKLLSKETSEELLPPPVQTQIKGHASAPYFGKEEPSVAPSSTGKTFQPGSWMPRDGKSHNQ

SEQ ID NO: 1136 - DNA, 1075 bp, Homo sapiens
gttttcttcgaagatttggggctccgcgatacagttaggatggctgtagtacctctgctgttgttggggggtttgtggagcgctgtgggagcgtccagcctgggtgtcgttacttgcggctccgtggtgaagctactcaatacgcgccacaacgtccgactgcactcacacgacgtgcgctatgggtcaggtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggccgaaacctccatagtcaccacttcacttcacctctttctggaaaccaggaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataattttattatga

SEQ ID NO: 1137 - protein, 211 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 1138 - DNA, 1972 bp, Homo sapiens
ctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaaaaaaaaaaaaa

SEQ ID NO: 1139 - protein, 432 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 1140 - DNA, 2534 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaa

SEQ ID NO: 1141 - protein, 516 aa, Homo sapiens
MDAMKRGLCCVLLLCGAVFVSPSQEIHARFRRGARSYQGCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1142 - DNA, 844 bp, Homo sapiens
cccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaaaaaaaaaaaaa

SEQ ID NO: 1143 - protein, 98 aa, Homo sapiens
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPEP

SEQ ID NO: 1144 - DNA, 1850 bp, Homo sapiens
cgcgctcgcagctcgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctgggtgacttttaaatatgacggctccaccatcgtccccggcgagcagggagcggagtaccagcacttcatccagcagtgcacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaaaagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctggaccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcctaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgtaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaaaaaaaaaaaaaaaaaaaaaaaaa

SEQ ID NO: 1145 - protein, 142 aa, Homo sapiens
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 1146 - DNA, 4221 bp, Homo sapiens
gtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggtacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttgcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctgcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattgggtccgtggcaaggaagctattaggaagtcaaacggtccaggatgcattacctgctaatccttaggtttaaagggggaaagaaaagggaagaagaaaggaaaagagaaatccaactcctttttcatgttttgcttttgaacaatgagggtttgtgtgacaggcattcctctttgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcaccaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaaaaaaaaaaaaaaaa

SEQ ID NO: 1147 - protein, 343 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 1148 - DNA, 2187 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccagcaagcacccatttgtggacagcaatcttctctaccagttcagaatgaacttccggcggaggcgaagactgatggagctgctcaatgaaaagtccccctcctcccaggaaactcatgacagtcccttctgcctggggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaaaaaaaaaaaaaaaaaaaa

SEQ ID NO: 1149 - protein, 409 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSSKHPFVDSNLLYQFRMNFRRRRRLMELLNEKSPSSQETHDSPFCLGKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 1150 - DNA, 2044 bp, Homo sapiens
ctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctaccgtcatggtgatggtgaagggagtgaacaaactggctctacccccaggcagtgtcatttcgtaccctttggagaatgcagttccttttagtcttgacagtgttgcaaattccattcactccttattttctgaggaaactcctgttgttttgcagttggctcccagtgaggaaagagtgtatatggtagggaaggcaaactcagtgtttgaagacctttcagtcaccttgcgccagctccgtaatcgcctgtttcaagaaaactctgttctcagttcactccccctcaattctctgagtaggaacaatgaagttgacctgctctttctttctgaactgcaagtgctacatgatatttcaagcttgctgtctcgtcataagcatctagccaaggatcattctcctgatttatattcactggagctggcaggtttggatgaaattgggaagcgttatggggaagactctgaacaattcagagatgcttctaagatccttgttgacgctctgcaaaagtttgcagatgacatgtacagtctttatggtgggaatgcagtggtagagttagtcactgtcaagtcatttgacacctccctcattaggaagacaaggactatccttgaggcaaaacaagcgaagaacccagcaagtccctataaccttgcatataagtataattttgaatattccgtggttttcaacatggtactttggataatgatcgccttggccttggctgtgattatcacctcttacaatatttggaacatggatcctggatatgatagcatcatttataggatgacaaaccagaagattcgaatggattgaatgttacctgtgccagaattagaaaagggggttggaaattggctgttttgttaaaatatatcttttagtgtgctttaaagtagatagtatactttacatttataaaaaaaaatcaaattttgttctttattttgtgtgtgcctgtgatgtttttctagagtgaattatagtattgacgtgaatcccactgtggtatagattccataatatgcttgaatattatgatatagccatttaataacattgatttcattctgtttaatgaatttggaaatatgcactgaaagaaatgtaaaacatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgttttttaaccctcttctgcaagtttgttgacctacatgggctaatatggatactaaaaatactacattgatctaagaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattccaaaaaaaaaa

SEQ ID NO: 1151 - protein, 350 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 1152 - DNA, 4080 bp, Homo sapiens
gcgcctgcggcgccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcagcctaccttatgttcagtattttggaggtgtctctgctctaagtaaacaacagtttctaaccatcaatggatttcctaataattattggggctggggaggagaagatgatgacatttttaacagattagtttttagaggcatgtctatatctcgcccaaatgctgtggtcgggaggtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacagctccccttggctcatcattcagatggctttccagatgaccaggacaggtgggatattttgcccccaacttggctcggcatgtgaattcttagctctgcaaggtgtttatgcctttgcgggtttcttgatgtgttcgcagtgtcacccaagagtcagaactgtagacatcccaaaatttggtggccgtggaacacattcccggtgatagaattgctaaattgtcgtgaaataggttagaatttttctttaaattatggttttcttattcgcgaaaattcggagagtgctgctaaaattggattggtgtcatctttttggtagttgtaatttaacagaaaaacacaaaatttcaaccattcttaatgttacgtcctccccccacccccttctttcagtggtatgcaaccactgcaatcaatgtgtcatatgtcttttcttagcaaaaggatttaaaacttgagccctggaccttttgcctatgtgtgtggattccagggcaactctagcatcagagcaaaagccttgggtttctcgcattcagtggcctatctccagattgtctgatttctgaatgtaaagttgttgtgtttttttttaaatagtaggtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctaagtatttttattctggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgcacccacaccccaactccctcccaagaacttcggtcctaaagcctcctgttccacctcaggttttcacaggtgctcacaccacagttgaggctcacacacaggtctgtctgtcacaaacccacctctgttgggagctattgagccacctgggatgagatgacacaagacactcctaccactgagcgcctttgtccaggtgccagcctgggctcaggttccaagactcagctgcctaatcccagggttgagccttgtgctcgtgtcggaccccaaaccactgccctcctggtaccagccctcagtgtggaggctgagctggtgcctggccccagtcttatctgtgcctttactgctttgcgcatctcagatgctaacttggttctttttccagaaggctttgtattggttaaaaattattttctattgcagagagcagctgtgactcatgcaaaaagtattttctctgtcagatccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgtttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgtaccgcgaagtgtgtcatgtgccgtgcccttttctgtttctgtgtatcctattgctggtgactctgtgtgaactggcctttgggaaagatcagagaggcagaggtggcacaggacagtaaaggagatgctgtgctgcctacagcctggacagggtctctgctgtactgccaggggcgggggctctgcatagccaggatgacgcctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctaactttgt

SEQ ID NO: 1153 - protein, 398 aa, Homo sapiens
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 1154 - DNA, 1591 bp, Homo sapiens
ccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaaggaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 1155 - protein, 256 aa, Homo sapiens
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 1156 - DNA, 1410 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaaaaaaaaaaaaaaaaaaa

SEQ ID NO: 1157 - protein, 343 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 1158 - DNA, 2168 bp, Homo sapiens
gtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctg

SEQ ID NO: 1159 - protein, 331 aa, Homo sapiens
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 1160 - DNA, 1358 bp, Homo sapiens
gcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaa

SEQ ID NO: 1161 - protein, 331 aa, Homo sapiens; identical to SEQ ID NO: 1159

SEQ ID NO: 1162 - DNA, 1897 bp, Homo sapiens
gtagatagtcagatgtcttttgaaaatgtgttttcggtgtggaatattaacccaatctttgataactcttccagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgaattataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcacatcagtaatctcttggactttgttaaatattttactgtggtaatatagagaagaattaaagcaaaaaaaaaaaaaaaaaaaaaaaaaaaaaa

SEQ ID NO: 1163 - protein, 331 aa, Homo sapiens; identical to SEQ ID NO: 1159

SEQ ID NO: 1164 - DNA, 3210 bp, Homo sapiens
gtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgtttcagagtagttcacaacagatctgagtgttttaattaagcatggaatacagaaaacaacaaaaaacttaagctttaatttcatctggaattccacagttttcttagctccctggacccggttgacctgttggtctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaatattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttatagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttcttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 1165 - protein, 331 aa, Homo sapiens; identical to SEQ ID NO: 1159

SEQ ID NO: 1166 - DNA, 1303 bp, Homo sapiens
ggcttctgggagcgaccgctccgctcgtctcgttggttccggaggtcgctgcggcggtgggaaatgctggcgcgcgcggcgcggggcactggggcccttttgctgaggggctctctactggcttctggccgcgctccgcgccgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaacctgaaaaaaaaaaaaaaaaaaaaaaaaaaaa

SEQ ID NO: 1167 - protein, 356 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 1168 - DNA, 2629 bp, Homo sapiens
accgccccgcgctccgctgccaggggcgggagggaggaatggttgcttcacgccccgggggaagagacgggaagctcggctctgggttgcgggccccggcgtctccgcgtggggcgcaccgtccgacccccccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagtttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatc

SEQ ID NO: 1169 - protein, 343 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 1170 - DNA, 1314 bp, Homo sapiens
cggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgataatt

SEQ ID NO: 1171 - protein, 343 aa, Homo sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 1172 - DNA, 2039 bp, Homo sapiens
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacacattg

SEQ ID NO: 1173 - protein, 480 aa, Homo sapiens
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 1174 - DNA, 2843 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 1175 - protein, 468 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 1176 - DNA, 1904 bp, Homo sapiens
agctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 1177 - protein, 463 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 1178 - DNA, 1978 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1179 - protein, 339 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 1180 - DNA, 2140 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1181 - protein, 339 aa, Homo sapiens; identical to SEQ ID NO: 1179

SEQ ID NO: 1182 - DNA, 2097 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtgggcagcacggggaaggacctgtgagtggccaacctggttcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1183 - protein, 339 aa, Homo sapiens; identical to SEQ ID NO: 1179

SEQ ID NO: 1184 - DNA, 2066 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1185 - protein, 339 aa, Homo sapiens; identical to SEQ ID NO: 1179

SEQ ID NO: 1186 - DNA, 2052 bp, Homo sapiens
gggagggtacttagggccggggctggcccaggctacggcggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaa

SEQ ID NO: 1187 - protein, 339 aa, Homo sapiens; identical to SEQ ID NO: 1179

SEQ ID NO: 1188 - DNA, 2993 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 1189 - protein, 518 aa, Homo sapiens
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 1190 - DNA, 2160 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaaaaaaaaaaaaaaaaaaa

SEQ ID NO: 1191 - protein, 291 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRTGRSVSSPATASMRPCLLSIRSG

SEQ ID NO: 1192 - DNA, 4269 bp, Homo sapiens
agcgggcagttgtgccccgccgaccatgcgccgcctcccgcgggccctgctgctgcagctgcgcctcgccctgctggtggccgcgggggccccggaggtgctggtcagcgcgccgcggagcctggtgtgggggcccgggctgcaggcggccgtcgtcctgccggtccgctatttctacctgcaggcggtcaactcggagggccagaacctcactcgctctcccgcaggtgaaacaccattcaaagtcgtagtcaaatctctttcacctaaagagttggtccggatacatgtccctaaacctttggacaggaatgatggaacattttcgatgagatataggatgtatgaaactgtcgatgaaggcctgacgatagaggtcctttatggtgatgaacatgtggctcagtctccctatatttcgaaaggaccagtgtaccatgagtactgtgagtgtccggaagatcctcaggcctggcagaagactctttcttgtccaaacaaggaaacacagattgcaaaagattttgcttcctttcccagcatcaatctccagcaaatgctaaaagaagtccccaaaagctttgggtatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaatttttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaaaaaaaaaaa

SEQ ID NO: 1193 - protein, 507 aa, Homo sapiens
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFSMRYRMYETVDEGLTIEVLYGDEHVAQSPYISKGPVYHEYCECPEDPQAWQKTLSCPNKETQIAKDFASFPSINLQQMLKEVPKSFGYERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 1194 - DNA, 3334 bp, Homo sapiens
gcacgagccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaaaaaaaaaaaaaaaaaaaa

SEQ ID NO: 1195 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 1196 - DNA, 1247 bp, Homo sapiens
gataatatctgtgcctcctgcccagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaaaaaaaaaaaaaaaaaaa

SEQ ID NO: 1197 - protein, 298 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 1198 - DNA, 2807 bp, Homo sapiens
ccactgtatgactgactccccggggacatgaggtggatactgttcattggggcccttattgggtccagcatctgtggccaagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcatccacatctagccaagccagtgaccttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgtttttttttttttgagacagagttttgctcttgttgcccaggctggagtgtgatggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacaggtgtgagccactgtgccgggcccgtcccctccttttttaggcctgaatacaaagtagaagatcactttccttcactgtgctgagaatttctagatactacagttcttactcctctcttccctttgttattcagtgtgaccaggatggcgggaggggatctgtgtcactgtaggtactgtgcccaggaaggctgggtgaagtgaccatctaaattgcaggatggtgaaattatccccatctgtcctaatgggcttacctcctctttgccttttgaactcacttcaaagatctaggcctcatcttacaggtcctaaatcactcatctggcctggataatctcactgccctggcacattcccatttgtgctgtggtgtatcctgtgtttccttgtcctggtttgtgtgtgtgtgtgtgtgtgtgtgtgtgtgtgtgtgtgtgtttgtgtgtgtgtgtctgtctattttgtatcctggaccacaagttcctaagtagagcaagaattcatcaaccagctgcctcttgtttcatttcacctcagcacgtaccatctgtccttttgttgttgttttgtttttgtttttttgcttttaccaaacatgtctgtaaatcttaacctcctgcctaggatttgtacagcatctggtgtgtgcttataagccaataaatattcaatgtgaaaaaaaaaaaaaaaaa

SEQ ID NO: 1199 - protein, 421 aa, Homo sapiens
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 1200 - DNA, 3320 bp, Homo sapiens
gtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctccactcacacatgtagacaaacattagctctttactctttctcaaccccttatatgattttaataattctcacttcactaattttgtaagcctgagatcaataagaaatgttcaggagagaggaaagaaaaaatatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaa

SEQ ID NO: 1201 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 1202 - DNA, 3693 bp, Homo sapiens
cgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacataaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgtcgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttaaaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccgttatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaattgaaatgaaaaaaaaaaaaaaaaaaaaaaa

SEQ ID NO: 1203 - protein, 223 aa, Homo sapiens
MKLHYVAVLTLAILMFLTWLPESLSCNKALCASDVSKCLIQELCQCRPGEGNCSCCKECMLCLGALWDECCDCVGMCNPRNYSDTPPTSKSTVEELHEPIPSLFRALTEGDTQLNWNIVSFPVAEELSHHENLVSFLETVNQPHHQNVSVPSNNVHAPYSSDKEHMCTVVYFDDCMSIHQCKISCESMGASKYRWFHNACCECIGPECIDYGSKTVKCMNCMF

SEQ ID NO: 1204 - DNA, 2312 bp, Homo sapiens
tccagtgacggagccgcccggccgacagccccgagacgacagcccggcgcgtcccggtccccacctccgaccaccgccagcgctccaggccccgcgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcttccccagacactggtttgaagaatgttaagacttgacagtggaactacattagtacacagcaccagaatgtatattaaggtgtggctttaggagcagtgggagggtaccagcagaaaggttagtatcatcagatagctcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttcctgtaacaagccagattttttaaaatttatattgtaaatattgtgtgtgtgtgtgtgtgtgtatatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctctcagatagaatgacagtccgtcaaaacagattgtttgcaaaggggaggcatcagtgtccttggcaggctgatttctaggtaggaaatgtggtagctcacgctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtatattttttctaaaaaaaaaaaaaaacgacagcaacggaattc

SEQ ID NO: 1205 - protein, 349 aa, Homo sapiens
MTAASMGPVRVAFVVLLALCSRPAVGQNCSGPCRCPDEPAPRCPAGVSLVLDGCGCCRVCAKQLGELCTERDPCDPHKGLFCDFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 1206 - DNA, 1904 bp, Homo sapiens
gcgccggctccgcgcctcgcgcccagtccgcgggccgcgccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggccggggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgtttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccataccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1207 - protein, 308 aa, Homo sapiens
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 1208 - DNA, 479 bp, Homo sapiens
agattccgtcgcttcttccggagccgtacgtggcaccgccccgcctcgcgggcgaccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaaatgtgtttatgtagtggcttaataaaaataaaatg

SEQ ID NO: 1209 - protein, 70 aa, Homo sapiens
MWFEILPGLSVMGVCLLIPGLATAYIHRFTNGGKEKRVAHFGYHWSLMERDRRISGVDRYYVSKGLENID

SEQ ID NO: 1210 - DNA, 3115 bp, Homo sapiens
cgctcccaggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtcttgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccctgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcaaaaaaaaaaaaaaa

SEQ ID NO: 1211 - protein, 346 aa, Homo sapiens
MTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 1212 - DNA, 1633 bp, Homo sapiens
atgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaaaaaaaaaaaaaaaa

SEQ ID NO: 1213 - protein, 501 aa, Homo sapiens
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 1214 - DNA, 1626 bp, Homo sapiens
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgaggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccaaaaaaaaaaaaaaaaaa

SEQ ID NO: 1215 - protein, 106 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEALLG

SEQ ID NO: 1216 - DNA, 2653 bp, Homo sapiens
atggccctgtccactgagcatcctcccgccacacagaaacccgcccagccggggccaccgaccccaccccctgcctggaaacttaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 1217 - protein, 562 aa, Homo sapiens
MDAMKRGLCCVLLLCGAVFVSPSQEIHARFRRGARSYQVICRDEKTQMIYQQHQSWLRPVLRSNRVEYCWCNSGRAQCHSVPVKSCSEPRCFNGGTCQQALYFSDFVCQCPEGFAGKCCEIDTRATCYEDQGISYRGTWSTAESGAECTNWNSSALAQKPYSGRRPDAIRLGLGNHNYCRNPDRDSKPWCYVFKAGKYSSEFCSTPACSEGNSDCYFGNGSAYRGTHSLTESGASCLPWNSMILIGKVYTAQNPSAQALGLGKHNYCRNPDGDAKPWCHVLKNRRLTWEYCDVPSCSTCGLRQYSQPQFRIKGGLFADIASHPWQAAIFAKHRRSPGERFLCGGILISSCWILSAAHCFQERFPPHHLTVILGRTYRVVPGEEEQKFEVEKYIVHKEFDDDTYDNDIALLQLKSDSSRCAQESSVVRTVCLPPADLQLPDWTECELSGYGKHEALSPFYSERLKEAHVRLYPSSRCTSQHLLNRTVTDNMLCAGDTRSGGPQANLHDACQGDSGGPLVCLNDGRMTLVGIISWGLGCGQKDVPGVYTKVTNYLDWIRDNMRP

SEQ ID NO: 1218 - DNA, 1270 bp, Homo sapiens
agacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaacttttttaaccaaacagaaaaaaaaaaaaaaaaaaaaaaaaaaaaaaaaa

SEQ ID NO: 1219 - protein, 252 aa, Homo sapiens
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 1220 - DNA, 4006 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttgaacaacatgttctaccgtggatttgtacttgctccttttgctctttttgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcatggtggtgggcgcctgtaatcccagttactcgggaggctgaggcaggagaatcacttgaacccgggaggcagaggttgcggtgagccaagagcgcaccattgcactccagccttgggcgacaaaaacgaaactccatcttcaaaacaaaacaaaacaaaacaaacaaacaaacaaaacttgcatcttaaccaaaagtcttggttttatcttaatccattaaaagttggtcttgtttccagcttgcattgattgctacaacatcactaatttggctttcacatttaaatggttctgtgctaatcaaaactttcgttgttattattcgttatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttgtggtgggattatgtgcctcccattcactagaaaatgagaaaattgtctgggttccaaaatattgacattgaatggatcaatacacacacacagacatatatatatatatatgcacacatatataggcagttgcatgcctagcatgggtattttataaccatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaatgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattctt

SEQ ID NO: 1221 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 1222 - DNA, 1038 bp, Homo sapiens
atgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaa

SEQ ID NO: 1223 - protein, 345 aa, Homo sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 1224 - DNA, 1497 bp, Homo sapiens
gttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagcctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacaaaaaaaaaaaaaaaaaaaaa

SEQ ID NO: 1225 - protein, 203 aa, Homo sapiens
MACGATLKRTLDFDPLLSPASPKRRRCAPLSAPTSAAASPLSAAAATAASFSAAAASPQKYLRMEPSPFGDVSSRLTTEQILYNIKQEYKRMQKRRHLETSFQQTDPCCTSDAQPHAFLLSGPASPGTSSAASSPLKKEQPLFTLRQVGMICERLLKEREEKVREEYEEILNTKLAEQYDAFVKFTHDQIMRRYGEQPASYVS

SEQ ID NO: 1226 - DNA, 1100 bp, Homo sapiens
ggcctcccacttggttgctcgtacgcggctagtgggtcctcagtggatgtaggctgggcgccgcgatgttcgacgggacaccggcggagagcgacctcggggttaaggggtggggctggacgtcaggagccaagatggcggcggtggtcgcactctccttgaggcgccggttgccggccacaacccttggcggagcctgcctgcaggcctcccgaggagcccagacagctgcagccacagctccccgtatcaagaaatttgccatctatcgatgggacccagacaaggctggagacaaacctcatatgcagacttataaggttgaccttaataaatgtggccccatggtattggatgctttaatcaagattaagaatgaagttgactctactttgaccttccgaagatcatgcagagaaggcatctgtggctcttgtgcaatgaacatcaatggaggcaacactctagcttgcacccgaaggattgacaccaacctcaataaggtctcaaaaatctaccctcttccacacatgtatgtgataaaggatcttgttcccgatttgagcaacttctatgcacagtacaaatccattgagccttatttgaagaagaaggatgaatctcaggaaggcaagcagcagtatctgcagtccatagaagagcgtgagaaactggacgggctctacgagtgcattctctgtgcctgctgtagcaccagctgccccagctactggtggaacggagacaaatatctggggcctgcagttcttatgcaggcctatcgctggatgattgactccagagatgacttcacagaggagcgcctggccaagctgcaggacccattctctctataccgctgccacaccatcatgaactgcacaaggacctgtcctaagggtctgaatccagggaaagctattgcagagatcaagaaaatgatggcaacctataaggagaagaaagcttcagtttaactgtttccatgctaaacatgatttataaccagctcagagctgaacataatttatatctaatttgagttcctttaaagatcttggttttccatgaatacagcatgtataataaaaattttaaga

SEQ ID NO: 1227 - protein, 280 aa, Homo sapiens
MAAVVALSLRRRLPATTLGGACLQASRGAQTAAATAPRIKKFAIYRWDPDKAGDKPHMQTYKVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPKGLNPGKAIAEIKKMMATYKEKKASV

SEQ ID NO: 1228 - DNA, 2074 bp, Homo sapiens
caagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgtggacactgcaagagacttgcacctgagtatgaagctgcagctaccagattaaaaggaatagtcccattagcaaaggttgattgcactgccaacactaacacctgtaataaatatggagtcagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1229 - protein, 505 aa, Homo sapiens
MRLRRLALFPGVALLLAAARLAAASDVLELTDDNFESRISDTGSAGLMLVEFFAPWCGHCKRLAPEYEAAATRLKGIVPLAKVDCTANTNTCNKYGVSGYPTLKIFRDGEEAGAYDGPRTADGIVSHLKKQAGPASVPLRTEEEFKKFISDKDASIVGFFDDSFSEAHSEFLKAASNLRDNYRFAHTNVESLVNEYDDNGEGIILFRPSHLTNKFEDKTVAYTEQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQDYFDGNLKRYLKSEPIPESNDGPVKVVVAENFDEIVNNENKDVLIEFYAPWCGHCKNLEPKYKELGEKLSKDPNIVIAKMDATANDVPSPYEVRGFPTIYFSPANKKLNPKKYEGGRELSDFISYLQREATNPPVIQEEKPKKKKKAQEDL

SEQ ID NO: 1230 - DNA, 1279 bp, Homo sapiens
atggggaaagtgtcctgctgtggcatgaaataaatgaaacagaaaatgatggcaagactgctaagaacatcctttgctttgctcttccttggcctctttggggtgctgggggcagcaacaatttcatgcagaaatgaagaagggaaagctgtggactggtttactttttataagttacctaaaagacaaaacaaggaaagtggagagactgggttagagtacctgtacctagactctacaactagaagctggaggaagagtgagcaactaatgaatgacaccaagagtgttttgggaaggacattacaacagctatatgaagcatatgcctctaagagtaacaacacagcctatctaatatacaatgatggagtccctaaacctgtgaattacagcagaaagtatggacacaccaaaggtttactgctgtggaacagagttcaagggttctggctgattcattccatccctcagtttcctccaattccggaagaaggctatgattatccacccacagggagacgaaatggacaaagtggcatctgcataactttcaagtacaaccagtatgaggcaatagattctcagctcttggtctgcaaccccaacgtctatagctgctccatcccagccacctttcaccaggagctcattcacatgccccagctgtgcaccagggccagctcatcagagattcctggcaggctcctcaccacacttcagtcggcccagggacaaaaattcctccattttgcaaagtcggattcttttcttgacgacatctttgcagcctggatggctcaacggctgaagacacacttgttaacagaaacctggcagcgaaaaagacaagagcttccttcaaactgctcccttccttaccatgtctacaatataaaagcaattaaattatcacgacactcttatttcagttcttatcaagatcatgccaagtggtgtatttcccaaaagggcaccaaaaatcgctggacatgtattggagacctaaatcggagtccacaccaagccttcagaagtggaggattcatttgtacccagaattggcaaatttaccaagcatttcaaggattagtattatactatgaaagctgtaagtaaacttggtgaaaggacacaggtactatcattgaaaaccttgacaatgggtcttcttccattacaccttctttatattttaaaggcctgtgaatatacttataacctgcatatcacaaaataaaacatttttctctcatgttaaaaaaaaaaaaaaaaaaaa

SEQ ID NO: 1231 - protein, 357 aa, Homo sapiens
MMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 1232 - DNA, 2120 bp, Homo sapiens
gctgcccgggctgcgcggcgtctgcaggcgccaccgctgcctctttccggctgtgaccctcctcgccggcgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaaatgttttatggtagcttttactttttatgaaaaaaaaattatttgccttttaaattcttttcccccatccccctccaaagtcttgatagcaagcgttattttgggggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaaaaaaaaaaaaaaa

SEQ ID NO: 1233 - protein, 398 aa, Homo sapiens
MNWHLPLFLLASVTLPSICSHFNPLSLEELGSNTGIQVFNQIVKSRPHDNIVISPHGIASVLGMLQLGADGRTKKQLAMVMRYGVNGVGKILKKINKAIVSKKNKDIVTVANAVFVKNASEIEVPFVTRNKDVFQCEVRNVNFEDPASACDSINAWVKNETRDMIDNLLSPDLIDGVLTRLVLVNAVYFKGLWKSRFQPENTKKRTFVAADGKSYQVPMLAQLSVFRCGSTSAPNDLWYNFIELPYHGESISMLIALPTESSTPLSAIIPHISTKTIDSWMSIMVPKRVQVILPKFTAVAQTDLKEPLKVLGITDMFDSSKANFAKITTGSENLHVSHILQKAKIEVSEDGTKASAATTAILIARSSPPWFIVDRPFLFFIRHNPTGAVLFMGQINKP

SEQ ID NO: 1234 - DNA, 728 bp, Homo sapiens
ttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacaaaaaaaaaaaaaaaaaaaaaaaaaa

SEQ ID NO: 1235 - protein, 148 aa, Homo sapiens
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 1236 - DNA, 980 bp, Homo sapiens
gcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgaaaaaaaaaaaaaa

SEQ ID NO: 1237 - protein, 240 aa, Homo sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 1238 - DNA, 2970 bp, Homo sapiens
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaa

SEQ ID NO: 1239 - protein, 432 aa, Homo sapiens
MPARPGRLLPLLARPAALTALLLLLLGHGGGGRWGARAQEAAAAAADGPPAADGEDGQDPHSKHLYTADMFTHGIQSAAHFVMFFAPWCGHCQRLQPTWNDLGDKYNSMEDAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 1240 - DNA, 1451 bp, Homo sapiens
actgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggcttgtatctctgggagcatatttttgaaggcttacttgatcccagcgatgtgactgctcaatggagagaaggaaagtcaatcgtaggaagaacacagtacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacactggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagct

SEQ ID NO: 1241 - protein, 443 aa, Homo sapiens
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 1242 - DNA, 1868 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgttttcaatgtataaggactatagtgatttaaactcatcaatgtgcctttgcataaagttgattaaataaatattgatgtggtataaatgcccatcagatatgct

SEQ ID NO: 1243 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 1244 - DNA, 1376 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaaaaa

SEQ ID NO: 1245 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 1246 - DNA, 1367 bp, Homo sapiens
ccggccggccgaagagttcacaagtgtgaagcctgaagccgccgggtgccgctgtgtagaaagaagctaaagcacttccagagcctgctgagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 1247 - protein, 375 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 1248 - DNA, 2492 bp, Homo sapiens
gttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcgtcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 1249 - protein, 496 aa, Homo sapiens
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 1250 - DNA, 2360 bp, Homo sapiens
acagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgaaaaaaaaaaaaaaa

SEQ ID NO: 1251 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 1252 - DNA, 1386 bp, Homo sapiens
gctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgaatctgcccgtaaaacctgagccattgattcttcagaactttctgcagtttttgacttcatagattatgctttaaaaaattttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttcacatagcctttgtgcaaaaaaaaaaaaaaaaaaaaa

SEQ ID NO: 1253 - protein, 317 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 1254 - DNA, 980 bp, Homo sapiens
ggggcagacgtgggacgggaaggacggctgccgggactggcgcgcggggacactgggccgacgcgtggagtagcggggagagcgggaagcctgagggggcggggccggcgcgaggccgtgggtgcggcacgaggatgccggcggcgggacagcgcccgtaggcagccccacgggcagggcgcgcgggcggggcggggcgggccgggccagaggagctcccggcatgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 1255 - protein, 127 aa, Homo sapiens
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 1256 - DNA, 1103 bp, Homo sapiens
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 1257 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 1258 - DNA, 1345 bp, Homo sapiens
ggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaaaaaaaaaaa

SEQ ID NO: 1259 - protein, 419 aa, Homo sapiens
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 1260 - DNA, 1701 bp, Homo sapiens
ccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaaaaaaaaaaa

SEQ ID NO: 1261 - protein, 175 aa, Homo sapiens
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 1262 - DNA, 2876 bp, Homo sapiens
gaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagc

SEQ ID NO: 1263 - protein, 402 aa, Homo sapiens [sequence omitted]

SEQ ID NO: 1264 - DNA, 2072 bp, Homo sapiens
aaacccccctgcatcgtagagagcgggctggattctctgtggtgctgatggaggagggggagcaggttgaaacaatcgagtgggcgcgccaggactccccagctcctggcggggaagggagggggagcccctgttctgcgcagggaggcggcggggctggggggcccccggaacgaggaagaggcaggggtgaccgctagaataggaaagtgctcacccccgggaggcaaaatttcgttcagatcgcacattaattggagatatctgattaattccagcttctgatgactataaatggcgattctctaccaaggtgtctatattaaaaaaaaaatcattccgtgtcatcccccacgtcaggcctgctcgtgggcgtgaggctgtacttcctccgcccccttctaatggagtgaaccattcccagctctcccccccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaaaaaaaaaaaaaaaaa

SEQ ID NO: 1265 - protein, 142 aa, Homo sapiens
MGLKLNGRYISLILAVQIAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 1266 - DNA, 3236 bp, Homo sapiens
gaccgggcggcgtgggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctaaaaaaaaaaaaaaaaaa

SEQ ID NO: 1267 - protein, 184 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 1268 - DNA, 4009 bp, Homo sapiens
acaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggcctccgcagcgccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaaaaaaaaaaaaaa

SEQ ID NO: 1269 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 1270 - DNA, 4119 bp, Homo sapiens
ctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagactctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaacgagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggctccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaacctttttttcctaaaaaaaaaaaaaaaaaaaaaaaaaaaaaaaaa

SEQ ID NO: 1271 - protein, 160 aa, Homo sapiens
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 1272 - DNA, 831 bp, Homo sapiens
ccatcttccggtctcctcagaagtcgcttagctcttcggtggttgtcccacgtccggaggcctagccgtcgcttacctaggatgccgcgtggaagccgaagccgcacctcccgcatggcccctccggccagccgggcccctcagatgagagctgcacccaggccagcaccagtcgctcagccaccagcagcggcacccccatctgcagttggctcttctgctgctgcgccccggcagccaggtctgatggcccagatggcaaccactgcagctggcgtggctgtgggctctgctgtggggcacacattgggtcacgccattactgggggcttcagtggaggaagtaatgctgagcctgcgaggcctgacatcacttaccaggagcctcagggaacccagccagcacagcagcagcagccttgcctctatgagatcaaacagtttctggagtgtgcccagaaccagggtgacatcaagctctgtgagggtttcaatgaggtgctgaaacagtgccgacttgcaaacggattggcctaatgaagaagttcaacctggagagatggaaaatcagctctcataactaagttaatttagtataaaaatagaattgatagtgagggtataaagtgtaaccatcagttaaacctctcctgtcattcctggcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaaaaaaaaaaaaaaaaa

SEQ ID NO: 1273 - protein, 151 aa, Homo sapiens
MPRGSRSRTSRMAPPASRAPQMRAAPRPAPVAQPPAAAPPSAVGSSAAAPRQPGLMAQMATTAAGVAVGSAVGHTLGHAITGGFSGGSNAEPARPDITYQEPQGTQPAQQQQPCLYEIKQFLECAQNQGDIKLCEGFNEVLKQCRLANGLA

SEQ ID NO: 1274 - DNA, 925 bp, Homo sapiens
gcgcggtagcatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttgggagataaagctgtgtactgccgttgttggaggtccaaaaagttcccattctgtgatggggctcacacaaaacataacgaagagactggagacaatgtgggccctctgatcatcaagaaaaaagaaacttaaatggacacttttgatgctgcaaatcagcttgtcgtgaagttacctgattgtttaattagaatgactaccacctctgtctgattcaccttcgctggattctaaatgtggtatattgcaaactgcagctttcacatttatggcatttgtcttgttgaaacatcgtggtgcacatttgtttaaacaaaaaaaaaaaaaaaaaaggaaaaaccaacctcatggcctgtgggttattttggtcttgtaaggatccatttctttaaaatactgacatatagagttgtaccttatatagaatatagttgtatcttgaagtcaacatattaaattattctcaaaattatgtatttgcagattgtacttgtaagtttcaaagaaaaattaccatcttttcatattgacctggaaactaaataggatgtgattcagctacattaatttcttaatacaatctaaaaaaaaaaaaaaaaaaaaaaaaaaaa

SEQ ID NO: 1275 - protein, 108 aa, Homo sapiens
MSLTSSSSVRVEWIAAVTIAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 1276 - DNA, 1973 bp, Homo sapiens
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 1277 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 1278 - DNA, 6160 bp, Homo sapiens
ctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttggctctttgccgagggcgtgtggtgagagtccccacagcgaccctggttcgagtggtgggcactgagctggtcatcccctgcaacgtcagtgactatgatggccccagcgagcaaaactttgactggagcttctcatctttggggagcagctttgtggagcttgcaagcacctgggaggtggggttcccagcccagctgtaccaggagcggctgcagaggggcgagatcctgttaaggcggactgccaacgacgccgtggagctccacataaagaacgtccagccttcagaccaaggccactacaaatgttcaacccccagcacagatgccactgtccagggaaactatgaggacacagtgcaggttaaagtgctggccgactccctgcacgtgggccccagcgcgcggcccccgccgagcctgagcctgcgggagggggagcccttcgagctgcgctgcactgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaagattccgtgcttgtggtgaaggcgaggcagccaaagcctttctttgctgccggaaatacatttgagatgacttgcaaagtatcttccaagaatattaagtcgccacgctactctgttctcatcatggctgagaagcctgtcggcgacctctccagtcccaatgaaacgaagtacatcatctctctggaccaggattctgtggtgaagctggagaattggacagatgcatcacgggtggatggcgttgttttagaaaaagtgcaggaggatgagttccgctatcgaatgtaccagactcaggtctcagacgcagggctgtaccgctgcatggtgacagcctggtctcctgtcaggggcagcctttggcgagaagcagcaaccagtctctccaatcctattgagatagacttccaaacctcaggtcctatatttaatgcttctgtgcattcagacacaccatcagtaattcggggagatctgatcaaattgttctgtatcatcactgtcgagggagcagcactggatccagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatgtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggttagtgagaaagggtatactttgtggtatgttttgctttcctaatagggacatgaaggaaacccagcaatttgctgttatgtgaatggcctgtagagcagagtcaagagcggtgtgctttgcccgactgctcccatcaggaataggagagtagacagagatcttccacatcccaggcttctgctgctgctttaaaagctctgtccttggagcctcccgctccctgaagtgtctcgccccctgcacagcactggcctttcggaagcatcccagtagggttttctgaggctcgctggtgactcatgccctaattgcaatcctctgcttttatcttgactttgaaggatctaacactgctctctcttccaaaggggaaaaaaagattcatttgttttgagcaataaactaatacaaaatgatggccattcatgtgcagctctttgtcaccatgggccggatgagttgtgctcctcctggctcaccatttccccctgctcccccacagccggttctgcacttatcaccgagtcgcccctggaagcagattcccattgagttttccccaccaaggggaccatgcacatggtagaaacattagattctgcattgacagtagcctttccttggcccgggcctgtggtgggaagacgggcaacaagtataccccaccagggcctgagtgactagaggaagaggacgaggccttgttggcactagatttgggtattttctgcatgtcataacatatcctaactgctatttcagaagaggcagcttgtaggtgattgtacaagtgagaattaaagagagaacagatatttaaacaggtgctgtattagtaacagccagtgccctttcagcccttgcatctattaaaaggagattcaggattttattggcacaggcccttcttagtaggaagaaagggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaattt

SEQ ID NO: 1279 - protein, 879 aa, Homo sapiens
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 1280 - DNA, 1988 bp, Homo sapiens
gccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagagacctgttttcacatgtggtggcattcttactggagagtctggatttattggcagtgaaggttttcctggagtgtaccctccaaatagcaaatgtacttggaaaatcacagttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggggatcagtattgtggaggactccttgacagaccttccggctcttttaaaacccccaactggccagaccgggattaccctgcaggagtcacttgtgtgtggcacattgtagccccaaagaatcagcttatagaattaaagtttgagaagtttgatgtggagcgagataactactgccgatatgattatgtggctgtgtttaatggcggggaagtcaacgatgctagaagaattggaaagtattgtggtgatagtccacctgcgccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtttaaaacccaccgtggccttgtgtcaacaaaagtgtagacggacggggactctggagggcaattattgttcaagtgactttgtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagagcattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1281 - protein, 415 aa, Homo sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 1282 - DNA, 4072 bp, Homo sapiens
acaccgccctcccgccagactcccggcggctcctcctccctctcccaaacccactcccaaagctaagtgcaggcttccccgttccagccagaagcgctgcgtgagcctccacacgtagccgcaggcagctccttaaatagcgtccgcgctgagcaaacagtccagacgtggggcccaggagggcgagctgaggcgaccgcaccgggcgcgcagcggcggcgggtcagccggcggccaatagccagggcgcggcccgccccgtcgcctcccctcggggagcctataaggcctccgcagcgccccgggcgcctgctgctccgtgcctccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaaaaaaaaaaaaaa

SEQ ID NO: 1283 - protein, 758 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 1284 - DNA, 1037 bp, Homo sapiens
gcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 1285 - protein, 300 aa, Homo sapiens
MAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 1286 - DNA, 1608 bp, Homo sapiens
aggacccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcctccctctcgttgcagaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgaatcac

SEQ ID NO: 1287 - protein, 155 aa, Homo sapiens
MAPISSLSLQTIGAAFVAKVMSVGDRTVTLGIWDTAGSERYEAMSRIYYRGAKAAIVCYDLTDSSSFERAKFWVKELRSLEEGCQIYLCGTKSDLLEEDRRRRRVDFHDVQDYADSSCSSALWGVGVCGCLGGSKKIGTALAARARCSRRSSWPP

SEQ ID NO: 1288 - DNA, 2324 bp, Homo sapiens
acatcgggaagccggaattacttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggattgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgccaggggctggaggcccctagaaaaagatcagtaagccccagtgtccccccagcccccatgcttatgtgaacatgcgctgtgtgctgcttgctttggaaactgggcctgggtccaggcctagggtgagctcactgtccgtacaaacacaagatcagggctgagggtaaggaaaagaagagactaggaaagctgggcccaaaactggagactgtttgtctttcctggagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagcccaaaaaaaaaaaaaaaaaaaaa

SEQ ID NO: 1289 - protein, 536 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 1290 - DNA, 2855 bp, Homo sapiens
agccccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtgggggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgatgggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccaaggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttaaaaaaaaaaaaaaaaaaaaa

SEQ ID NO: 1291 - protein, 261 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 1292 - DNA, 3217 bp, Homo sapiens
ggccgggagacctggcggagctgggggtggggggccagtttttgcaacggctaaggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaaaaaaaaaaaaaaaaa

SEQ ID NO: 1293 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 1294 - DNA, 2764 bp, Homo sapiens
ctctaaagcttagagccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcgaattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaattttttttcctctatttatcaatgatatatttcacttttaaaggaaattttggaggaaaatatagctgctttttgcctaaaaaaccttgtgggtggaaatattcctctgagaatggcttttataggtattttgcctggtaatgtattcattcatgattgcccatattcttgaatgtttcttcattccaatggggtcaggtcaatattatgaaaataatttttatatttatatttgtaactaagaatttatttctccctttactacacgatgtaaattcacgtcaaattcgatgatctgaggatttaaattcacaaaacctgccactacattctggtttacattagttacttcatgctggctggggttagtgaccatttgcatactcttttaaatcaaggaggctgtagtagaggcagttttaagattcttgaaggcaaaatttgaaaaacagtgaatacttctaattgtttccttttagtgccagaactaagacattgtgaagcacttgttagtaaacttaaccttgaaatgtcagactggaaggagtttttatgtctttgtgcatacttctgggtattacagaaacagtctgtaaataacattttaagatgcaaatttaattctgttcacagctgatttatactgattt

SEQ ID NO: 1295 - protein, 510 aa, Homo sapiens
MAGSRQRGLRARVRPLFCALLLSLGRFVRGDGVGGDPAVALPHRRFEYKYSFKGPHLVQSDGTVPFWAHAGNAIPSSDQIRVAPSLKSQRGSVWTKTKAAFENWEVEVTFRVTGRGRIGADGLAIWYAENQGLEGPVFGSADLWNGVGIFFDSFDNDGKKNNPAIVIIGNNGQIHYDHQNDGASQALASCQRDFRNKPYPVRAKITYYQNTLTVMINNGFTPDKNDYEFCAKVENMIIPAQGHFGISAATGGLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 1296 - DNA, 5556 bp, Homo sapiens
acggctgcgagaagacgacagaaggggaggcattgcctcgctgctttcttttcaccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcaccaaagatgtcagagattatcctggaatttgaaagctttgacctggagcctgactcaaatcctccaggggggatgttctgtcgctacgaccggctagaaatctgggatggattccctggtgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggcggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgttcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgaggcccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaataaaaaaaaaaaaaaaaaaaa

SEQ ID NO: 1297 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPGVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 1298 - DNA, 1655 bp, Homo sapiens
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcggggcgctactgggctgagatctcggataccatcatctctggcaccttccaccagtggagagagggcaccaccaaaagtgaggtcttctacccaggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttcc

SEQ ID NO: 1299 - protein, 223 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 1300 - DNA, 2302 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaaatgtattttaaaaggaaactgtactacatctagttaatcataggtttgatatgtagttacgtattttttctaatgtgcattaaaacaaatccataattattaaaataaatgttgtttgtgtgcc

SEQ ID NO: 1301 - protein, 487 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKGAAVAFWWTIGWPWNV

SEQ ID NO: 1302 - DNA, 1746 bp, Homo sapiens
atgtgggggcgcacggcgcggcggcgctgcccgcgggaactgcggcgcggccgggaggcgctgttggtgctcctggcgctactggcgttggccgggctgggctcggtgctgcgggcgcagcgtggggccggggccggggctgccgagccgggacccccgcgcaccccgcgccccgggcggcgcgagccggtcatgccgcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgtgcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatga

SEQ ID NO: 1303 - protein, 581 aa, Homo sapiens
MWGRTARRRCPRELRRGREALLVLLALLALAGLGSVLRAQRGAGAGAAEPGPPRTPRPGRREPVMPRPPVPANALGARGEAVRLQLQGEELRLQEESVRLHQINIYLSDRISLHRRLPVRWNPLCKEKKYDYDNLPRTSVIIAFYNEAWSTLLRTVYSVLETSPDILLEEVILVDDYSDREHLKERLANELSGLPKVRLIRANKREGLVRARLLGASAARGDVLTFLDCHCECHEGWLEPLLQRIHEEESAVVCPVIDVIDWNTFEYLGNSGEPQIGGFDWRLVFTWHTVPERERIRMQSPVDVIRSPTMAGGLFAVSKKYFEYLGSYDTGMEVWGGENLEFSFRIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERML

SEQ ID NO: 1304 - DNA, 1743 bp, Homo sapiens
aaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 1305 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 1306 - DNA, 3291 bp, Homo sapiens
ggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttaaaaaaa

SEQ ID NO: 1307 - protein, 575 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 1308 - DNA, 3775 bp, Homo sapiens
cgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttaaaaaaaaaaaaaaaaa

SEQ ID NO: 1309 - protein, 575 aa, Homo sapiens; identical to SEQ ID NO: 1307

SEQ ID NO: 1310 - DNA, 3677 bp, Homo sapiens
cgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcggcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttaaaaaaaaaaaaaaaaa

SEQ ID NO: 1311 - protein, 575 aa, Homo sapiens; identical to SEQ ID NO: 1307

SEQ ID NO: 1312 - DNA, 2997 bp, Homo sapiens
agtgggcggggcctccttgaggaccccgggctgggcgccgccgccggttcgtctactctttccttcagccgcctcctttcaaccttgtcaacccgtcggcgcggcctctggtgcagcggcggcggctcctgttcctgccgcagctctctccctttcttacctccccaccagatcccggagatcgcccgccatggctttacttactgcggccgcccggctcttgggaaccaagaatgcatcttgtcttgttcttgcagcccggcatgccagtgcttcctccacgaatttgaaagacatattggctgacctgatacctaaggagcaggccagaattaagactttcaggcagcaacatggcaagacggtggtgggccaaatcactgtggacatgatgtatggtggcatgagaggcatgaagggattggtctatgaaacatcagttcttgatcctgatgagggcatccgtttccgaggctttagtatccctgaatgccagaaactgctacccaaggctaagggtggggaagaacccctgcctgagggcttattttggctgctggtaactggacatatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccgagcatatgcacagggtatcagccgaaccaagtactgggagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacagtgaccatgagggtggcaatgtaagtgcccataccagccatttggtgggcagtgccctttccgacccttacctgtcctttgcagcagccatgaacgggctggcagggcctctccatggactggcaaatcaggaagtgcttgtctggctaacacagctgcagaaggaagttggcaaagatgtgtcagatgagaagttacgagactacatctggaacacactcaactcaggacgggttgttccaggctatggccatgcagtactaaggaagactgatccgcgatatacctgtcagcgagagtttgctctgaaacacctgcctaatgaccccatgtttaagttggttgctcagctgtacaagattgtgcccaatgtcctcttagagcagggtaaagccaagaatccttggcccaatgtagatgctcacagtggggtgctgctccagtattatggcatgacggagatgaattactacacggtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggtgaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcccttcccctgcctggtatgagttgcccatcatacgcatggtcctggaggatgaccaggactaatgcatgtggtatgagtaggtttggccccctcactatctctagagtgagaatctggctcctgtttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatgaaaaaaaaaaaaaaaaaaaaa

SEQ ID NO: 1313 - protein, 466 aa, Homo sapiens [sequence omitted]

SEQ ID NO: 1314 - DNA, 1791 bp, Homo sapiens
cccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaaa

SEQ ID NO: 1315 - protein, 510 aa, Homo sapiens
MYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 1316 - DNA, 3004 bp, Homo sapiens
agtgcgtggcagcgggacctgcggccccgtcgcgaagtttccagccctgcgagcgccgccgggtcggccgatcgtcccccatacctcggccatgcggcccctgctgctactggccctgctgggctggctgctgctggccgaagcgaagggcgacgccaagccggaggacaaccttttagtcctcacggtggccactaaggagaccgagggattccgtcgcttcaagcgctcagctcagttcttcaactacaagatccaggcgcttggcctaggggaggactggaatgtggagaaggggacgtcggcaggtggagggcagaaggtccggctgctgaagaaagctctggagaagcacgcagacaaggaggatctggtcattctcttcgcagacagctatgacgtgctgtttgcatcggggccccgggagctcctgaagaagttccggcaggccaggagccaggtggtcttctctgctgaggagctcatctacccagaccgcaggctggagaccaagtatccggtggtgtccgatggcaagaggttcctgggctctggaggcttcatcggttatgcccccaacctcagcaaactggtggccgagtgggagggccaggacagcgacagcgatcagctgttttacaccaagatcttcttggacccggagaagagggagcagatcaatatcaccctggaccaccgctgccgtatcttccagaacctggatggagccttggatgaggtcgtgctcaagtttgaaatgggccatgtgagagcgaggaacctggcctatgacaccctcccggtcctgatccatggcaacgggccaaccaagctgcagttgaactacctgggcaactacatcccgcgcttctggaccttcgaaacaggctgcaccgtgtgtgacgaaggcttgcgcagcctcaagggcattggggatgaagctctgcccacggtcctggtcggcgtgttcatcgaacagcccacgccgtttgtgtccctgttcttccagcggctcctgcggctccactacccccagaaacacatgcgacttttcatccacaaccacgagcagcaccacaaggctcaggtggaagagttcctggcacagcatggcagcgagtaccagtctgtgaagctggtgggccctgaggtgcggatggcgaatgcagatgccaggaacatgggcgcagacctgtgccggcaggaccgcagctgcacctactacttcagcgtggatgctgacgtggccctgaccgagcccaacagcctgcggctgctgatccaacagaacaagaacgtcattgccccgctgatgacccggcatgggaggctgtggtcgaacttctggggggctctcagtgcagatggctactatgcccgttccgaggactacgtggacattgtgcaggggcggcgtgttggtgtctggaatgtgccctatatttcaaacatctacttgatcaagggcagtgccctgcggggtgagctgcagtcctcagatctcttccaccacagcaagctggaccccgacatggccttctgtgccaacatccggcagcaggatgtgttcatgttcctgaccaaccggcacacccttggccatctgctctccctagacagctaccgcaccacccacctgcacaacgacctctgggaggtgttcagcaaccccgaggactggaaggagaagtacatccaccagaactacaccaaagccctggcagggaagctggtggagacgccctgcccggatgtctattggttccccatcttcacggaggtggcctgtgatgagctggtggaggagatggagcactttggccagtggtctctgggcaacaacaaggacaaccgcatccagggtggctacgagaacgtgccgactattgacatccacatgaaccagatcggctttgagcgggagtggcacaaattcctgctggagtacattgcgcccatgacggagaagctctaccccggctactacaccagggcccagtttgacctggcctttgtcgtccgctacaagcctgatgagcagccctcactgatgccacaccatgatgcctccaccttcaccatcaacatcgccctgaaccgagtcggggtggattacgagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaacca

SEQ ID NO: 1317 - protein, 727 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 1318 - DNA, 1504 bp, Homo sapiens
ccacgctcgtgccgccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgtgaactccttagagaagtttcacttcaagtcatggatgtctaagcaccgtaagacctacagtacggaggagtaccaccacaggctgcagacgtttgccagcaactggaggaagataaacgcccacaacaatgggaaccacacatttaaaatggcactgaaccaattttcagacatgagctttgctgaaataaaacacaagtatctctggtcagagcctcagaattgctcagccaccaaaagtaactaccttcgaggtactggtccctacccaccttccgtggactggcggaaaaaaggaaattttgtctcacctgtgaaaaatcagggtgcctgcggcagttgctggactttctccaccactggggccctggagtctgcgatcgccatcgcaaccggaaagatgctgtccttggcggaacagcagctggtggactgcgcccaggacttcaataatcacggctgccaagggggtctccccagccaggctttcgagtatatcctgtacaacaaggggatcatgggtgaagacacctacccctaccagggcaaggatggttattgcaagttccaacctggaaaggccatcggctttgtcaaggatgtagccaacatcacaatctatgacgaggaagcgatggtggaggctgtggccctctacaaccctgtgagctttgcctttgaggtgactcaggacttcatgatgtatagaacgggcatctactccagtacttcctgccataaaactccagataaagtaaaccatgcagtactggctgttgggtatggagaaaaaaatgggatcccttactggatcgtgaaaaactcttggggtccccagtggggaatgaacgggtacttcctcatcgagcgcggaaagaacatgtgtggcctggctgcctgcgcctcctaccccatccctctggtgtgagccgtggcagccgcagcgcagactggcggagaaggagaggaacgggcagcctgggcctgggtggaaatcctgccctggaggaagttgtggggagatccactgggacccccaacattctgccctcacctctgtgcccagcctggaaacctacagacaaggaggagttccaccatgagctcacccgtgtctatgacgcaaagatcaccagccatgtgccttagtgtccttcttaacagactcaaaccacatggaccacgaatattctttctgtccagaagggctactttccacatatagagctccagggactgtcttttctgtattcgctgttcaataaacattgagtgagcacctccccagatggaaaaaaaaaaaaaaaaaaaaaaaaaaaaaaaaaaaaa

SEQ ID NO: 1319 - protein, 335 aa, Homo sapiens
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 1320 - DNA, 2538 bp, Homo sapiens
gctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtgtctgtccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaaaaaaaaaaaaaaaaaaaaaa

SEQ ID NO: 1321 - protein, 318 aa, Homo sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSVQARNETIARRLWDVSCDLLGLPID

SEQ ID NO: 1322 - DNA, 4336 bp, Homo sapiens
agcggagagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacatatgcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccgcgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgctcatcgaaggtcttttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgatttttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcaaaaaaaaaaaaaaaaaaaaaaagaaaaaaaaaaaaaaaa

SEQ ID NO: 1323 - protein, 408 aa, Homo sapiens
MRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 1324 - DNA, 1580 bp, Homo sapiens
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctgggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccaaaaaaaaaaaaaaaaaa

SEQ ID NO: 1325 - protein, 192 aa, Homo sapiens
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGETVVHGPGEATAVEWGPNTWMVEYGRGVIPSTLAFALADTVFSTQDFLTLFYTLRSYARGLRLELTTYLFGQDP

SEQ ID NO: 1326 - DNA, 1182 bp, Homo sapiens
aatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgcaaaaaaaaaaa

SEQ ID NO: 1327 - protein, 157 aa, Homo sapiens
MSGSLGRAAAALLRWGRGAGGGGLWGPGVRAAGSGAGGGGSAEQLDALVKKDKVVVFLKGTPEQPQCGFSNAVVQILRLHGVRDYAAYNVLDDPELRQGIKDYSNWPTIPQVYLNGEFVGGCDILLQMHQNGDLVEELKKLGIHSALLDEKKDQDSK

SEQ ID NO: 1328 - DNA, 4593 bp, Homo sapiens
ggggctgtctgggctcggggcgcggcggcagtcagctctatgttcgcggtcttaacctctcctctggccgagtccttgcaagaagtgaattacccgaccctgcaaaacacttactattttggagtttaaagtatgtcatcatggcaaagtttcggagaaggacttgcatcattttggcactttttattctatttattttctctctgatgatgggtttaaaaatgctgagaccaaatacagctacttttggagctccttttggacttgaccttcttccagaacttcatcaacgaactattcatttggggaaaaattttgatttccaaaagagtgacagaatcaacagtgaaacaaataccaagaatttaaaaagtgttgaaatcactatgaaaccttccaaagcctctgaacttaacttggatgaactaccacctctgaacaattatctacatgtattttattacagttggtatggaaatccacaatttgatggtaaatatatacattggaatcatccagtgttagagcattgggaccctagaatagccaagaattatccacaagggagacacaaccctccagatgacattggctccagcttttatcctgaattgggaagttacagttctcgggatccttctgtcatagaaactcacatgagacaaatgcgctcagcttcaattggtgtactagccctctcttggtacccacctgatgtaaatgatgaaaatggagaacctactgataacttggtacccactattttggataaagctcataaatataacctaaaggttacttttcacatagaaccatatagcaatcgagatgatcaaaacatgtacaaaaatgtcaagtatattatagacaaatatggaaatcatccggccttttacaggtacaagacgaagactggcaatgctcttcctatgttttatgtctatgattcctatattaccaagcctgaaaaatgggccaatctgttaaccacctcagggtctcggagtattcgcaattctccttatgatggactgtttattgcccttctggtagaagaaaaacataagtatgatattcttcaaagtggttttgatggaatttacacatattttgccacaaatggctttacttatggctcatcacatcagaattgggctagcctaaaattattttgtgataaatacaacttaatatttatcccaagtgtgggcccaggatacatagataccagcatccgtccatggaacacgcaaaacactcggaaccgaatcaatgggaagtattatgaaattggtctgagtgccgcacttcagacacgccccagcttaatttctatcacctcttttaatgagtggcatgaaggaactcagattgaaaaagctgttcccaaaagaaccagtaatacagtgtacctagattaccgtcctcataaaccaggtctttacctagaactgactcgcaagtggtctgaaaaatacagtaaggaaagagcaacttatgcattagatcgccagctgcctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgttacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggaaggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcctgaagtttggctttacattaagtttagcactgtatcagaatgaagaaactaatattttacataaaaactaatactttcaattttttatatagtaatatccccattttgtaaatgttagacttttatcatacctgtaagttaaaatacttgttatcaataacttgtcatattgtgacaaattgatcacttgtgtacgaaaaataaatctccttaaaaactaaataaaatgcactgtattcttacagttaatgtttataactatagtaaaaaattaatatatatcctattacataaatgttatttcttaggtgttccattaagaagagcaatagaataatgctaaaaaataatgcctataaatcttcagagtataaagacatccattcagaaacaaaaattagcactaaattttttataaaatagaccagatgacaaaatttattttatttttaaacagtggttttgacacaaattatgttattgaaaagcattattaatgtttaatttatttaaaattttggaatttgccatttctcagacaatgatcaggccttaggaaattaatacagtagtagtaatcattttctaggggaaaataaaagaataaatcactatactgatattttgatataagcaagcacttacatggtaatcactatatagatccaacctgtggattttcttcttatgtccatttaactagaatatattattttaggtataatttacaaatgtcacacctaataatcttttataatataccatatttcattaaagttttgttagagaagtatctaccacagaggagtttttgtcattgtgtacgttgtgtatttgaacccaccatgacagaaagtaaattttaggaaatagttatgagattaagggaaaatctataaaaacaaggttagcatattctcaacacagataccaccactttctttttcccattatagacatggtgaatccacacagcatacttcatctctgagctttgttgtgattcctcaacacattaccctaaccagccagcagtaacagatttcagagtaagataaagcagattctgtcttcattgcaaaaagttattctcaatggaagaatggcatctgatctcataattactagtttatattaatatagtttttttctccctttttaataaaataattacagtcatccctcagtgtctgtgggggattggttccagttacccctatagataccaaaatctgcagatgctcaagtccctgatataaactggcatagtagttgcatataatctatgcacatcctcctgtatacattaagtcatctctagattatttataacacttaatacaatgtaaatgctatgtagttgttataccatactggttagtgaataattacatgaaaaaaaagagtctgtacatcttcagagtttcagtcggcaatttcttggccatggatgtagaacctacagataaggtgagccaactgcattaggaaataactctaataattctgttaattcttagagaggaaaactttcaaaatcttcctcaggtatttattacaactgcctttaccattttagttgtaacacagtttaaattgttatgataacaagtaaataagagcaaagaatttatttcttaattcaaaactatacgtttgaattcaatatggtataacttaaagtggtataatacatacaatgcatgaatcataatggattcttttataagttattaatttttatggtttaatcagtctaattgttttgactgttatagaaaccaaatattttactgtttcttttaaggactaatattgtcaaaaactgctgttattaacttcacttgagttgtttaacttccttctgttttaagattgtaattaaaaattactattttgttatatggaatggttaatttttacctaataaaaacatagatgaaatacattgaaaaaaaaaaaaaaaaaaa

SEQ ID NO: 1329 - protein, 462 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLFCDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 1330 - DNA, 2063 bp, Homo sapiens
tgccgggcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaagcagcgagcgggcctggagaacatggacagggcggcgcagcgcttccggctccagaacccagacctggactcagaggcgctgctagccctgcccctgcctcagctggtgcagaagttacacagtagagagctggcccctgaggccgtgctcttcacctatgtgggaaaggcctgggaagtgaacaaagggaccaactgtgtgacctcctatctggctgactgtgagactcagctgtctcaggccccaaggcagggcctgctctatggcgtccctgtgagcctcaaggagtgcttcacctacaagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcagcaagagtggcctgaagggctgtgtctatggacaggaggcagtgcgtctctccgtgggccccatggcccgggacgtggagagcctggcactgtgcctgcgagccctgctgtgcgaggacatgttccgcttggaccccactgtgcctcccttgcccttcagagaagaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcgttcggctggaaaactctgggaactgcagcacgagatcgaggtgtaccgcaaaaccgtgattgcccagtggagggcgctggacctggatgtggtgctgacccccatgctggcccctgctctggacttgaatgccccaggcagggccacaggggccgtcagctacactatgctgtacaactgcctggacttccctgcaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacaaaaaaaaaaaaaaaaaaa

SEQ ID NO: 1331 - protein, 579 aa, Homo sapiens
MVQYELWAALPGASGVALACCFVAAAVALRWSGRRTARGAVVRARQKQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 1332 - DNA, 3568 bp, Homo sapiens
gttccggcggcagctgcggcggtggcggagactccctttgtcctctcaggacctccctctctccctccctgtcagctggtgggtcccgctgccgcaggcgccggcgtctcagctgctcgccgccccccaccccagagtgcgtgcagggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattctatactagctcagtcatgtactgaaatcctagaattgcagccctcaagtgtctgtgtgggggaggaatttcagattgtcttaagtggaagaggattcatgctgggcagtcggaatggcagtgttctctgcacttacactgtaaatgaaacatatacaacgagtgtaaaaccagtaagtgtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggcccctttgctgcaaagtggttattaaggatcctccaccaccacccgcccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgagggccggtgcataaacttctcccgagttccatctcagtaaaagggaagcaggaagaccaagaaggtacgaagatggcacattttcacatagctgattttcaaccaaatgaaaaaaatcaagtgcatttcagaagcttttggaagagcagcttaattcctctcagtcgggaaatgttttctctgccttctgctttgcttgcaccaaacatttctaaacacttgttctgccatctacatgggaggtgatgaaactcagtggtaactcatgatttatgacattgaaaataaagaggaacattgacctgcagactatggtttgtacaagaaagtttgtttgaatgtgtagaagaggaaaaagcaacaacagcaacaacacgaagatgataccaaaacaaggaccacaaaacaactagccatgatgggagacaggagttttttacatggaaacatggcacttgtgtttttatgtggcaagatctttatccataggcagagtatgaaatttcccaccaggctaagcaaataaagaagtccattgccttatagctatgtcagatcacagaatccttccaagtgctctatcacagtgtgccttatgggaagtttctgactggaaaatcttgtcattctaacactgaaaagtgcacacgcatgacaaaatgtagacaagatgcctcaaggtattggtagcaagcaagattttgccctttagttttcgaagacacctttctttcattatgcactcgggacaagaaaattaatagagcgttattccacagaaggcctctagccagagatcttgagtgtagtgcaagggactcattttttgcgaacttgtccctgtgactagtagattcccccttttcctgtgtttaggatttagtagtgcataaagcattaatatccataaacatacctagaagtttgttttgcttttaatttaaaggaagcagtaaccacaaagcttccgctcagggttttttctttcttcaagtctccaagggctcttcagcgtcacaagccagcaactctctttgcattaaaatttcaaagtttaattaatataattaaaagcaacagcaagcagcagcctgtgaagattttgctcatcttttttatgccttttgacattgaatgacctattactgtatgcgcattacttggattttgaggggcactctaccttggttatgattcagtagaggaaaaagaccacctttcttcaatttacaaattaaatcttctggagggtcgctatcacaaaacattgacgatgtatgtattataattttttagaaaaaccaccatcgtgtcacgtcgacgatgccaaattatgttagcgtgagcagaaacaccgtgggggaggaaggcagcagctgaagaaaaaagctcaaatgatctagtcactttcgatactgtacttcagatgcgaaatggatattcgagtggaaacctgacaaagtgcgcctgctttgatgtgaactggtatagacaatgaccagtggctgggtcagtgggatgtctctctgtgagcacaaaggcttatcaaatgacactaaaaataagttcaacaaccatcacattggaagggagaaggcgaacatttcatgtttggcgggcatgtgagtgcacaagatggaaagagcgattggagcatcctggtataattacccccattgtgctcttaatggaaatttcaaaggacgggagtattctgttggttggtgtccaggtttgtggcactgttccaagaggccttacacacacacacaaatatataattttctatacatatatatcctctagcttgaaacttttgctcaagtttatttatgtcactggctggctggatccaaagtcatgtgtccacacattcataaataaaaattttacctatgaaaaaaaaaaaaaaaaa

SEQ ID NO: 1333 - protein, 488 aa, Homo sapiens
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEGRCINFSRVPSQ

SEQ ID NO: 1334 - DNA, 508 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaa

SEQ ID NO: 1335 - protein, 84 aa, Homo sapiens
MATMENKVICALVLVSMLALGTLAEAQTETCTVAPRERQNCGFPGVTPSQCANKGCCFDDTVRGVPWCFYPNTIDVPPEEECEF

SEQ ID NO: 1336 - DNA, 3705 bp, Homo sapiens
gatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacactttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgaaaaaaaaaaaaaaaaaaaaaaa

SEQ ID NO: 1337 - protein, 308 aa, Homo sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 1338 - DNA, 3254 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 1339 - protein, 652 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 1340 - DNA, 2326 bp, Homo sapiens
gtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgcatccgcgtcagcacgggcagcgtgcacgaggtgctggagttggccgacaggttcctactcattcgtttaaaagaattttgtggagaatttctcaagaaaaaacttcatctctcaaattgtgtggcaattcatagcttagcacacatgtacaccctgagccaacttgctctgaaggctgctgatatgatacggagaaatttccacaaagtgattcaggatgaagaattttatacgttacctttccatctcattagagactggctttcagatttggaaattacagttgattctgaagaggttctctttgaaaccgttttgaaatgggttcagagaaatgctgaagagagagagagatactttgaagaactttttaaattgctcaggttgtcccagatgaaacctacctaccttactcgacatgtcaaaccagagaggctggtagccaataatgaagtttgtgtcaagttggtcgctgacgcagtggagagacatgctctgagagctgagaatatacaatctggcacatgccagcaccccacttctcatgtgtcactattgcctcgttatgggcaaaacatggatgtgatcatggttattggaggtgtgtcagaaggaggggactatttaagtgaatgtgtgggatattttgttgatgaggacagatgggtaaatctgccacatattcataatcacctcgatggacatgctgttgcagtaacagaatcctacgtgtatgttgctggatcaatggagccagggtttgctaaaactgtagaaaggtataacccaaatttgaatacatgggaacatgtttgtagtctgatgacaagaaagcattcttttggactaacagaagtcaaagggaagctctatagcattggaggacatggcaactttagtcctggttttaaagatgtgactgtttataatcctgagcttgataaatggcacaacttggaatcggcaccaaagattcttcgagatgtcaaagcactagccattgaagaccggtttgtatacattgccgcccgcactcctgtagaccgggacactgaagatggattaaaggctgtaattacttgctatgatacagagactcgacagtggcaagatgtggaatctttgccgcttattgacaattactgctttttccaaatgtctgtggtcaattcaaacttttatcagacagcatcatgttgtcccaagagttattgtttagaaaacgaagaggcagtaagaaaaattgccagccaagtgtctgatgagatccttgaaagcttgcctccagaagtcctaagcatcgaaggagcagccatttgctattacaaagatgatgtcttcattataggaggctggaaaaacagtgatgatattgataaacagtatcggaaagaagcctaccgatattgtgcggagaggaagaggtggatgcttcttcctcctatgccacaacctcgttgtagagccactgcttgtcacgtgaggatcccataccggtacttgcatggcacacagagataccctatgcctcaaaacctgatgtggcagaaggaccgcatcagacagatgcaagagatacatcgtcacgccctgaacatgaggcgagtgccaagctctcagattgaatgctaggttctctcaagcgtgccgattaaaactgttacacccgtttcgtgaagctgaagatacccaggctgttatttaaaaaagtatgtcgataacttattttctacatgaactgattattaccccatataaaggaaatagagttaaaaactaaagaatgggagactcagttcaatacatggtcattttgttagcttgc

SEQ ID NO: 1341 - protein, 708 aa, Homo sapiens
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 1342 - DNA, 2930 bp, Homo sapiens
agggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgaggattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaagggctgggggcaaaggggcatgatccagggtcccccagggtgggctcagctccagggagaggccacccacgtggcagccccacctcttgagagcccccagtgccggagcagaaaggaccctggacccagaggcagatactgcggggtggtagaaaaggtagagtaggctgtggcaatggaataaaacacgattaaaaacgttaaaaaaaaaaaaaaaaaaaa

SEQ ID NO: 1343 - protein, 645 aa, Homo sapiens
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 1344 - DNA, 4295 bp, Homo sapiens
gaggaggttcctgtagggcggcacaaccagggagggcgtggaagctctgcatcccttctcccataccttgctctacacatctcttcatctgtatcctctgcagcatccttgatgataaaccagtaaatatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaaaaaaaaaaaaaaaa

SEQ ID NO: 1345 - protein, 406 aa, Homo sapiens
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 1346 - DNA, 4403 bp, Homo sapiens
gcccggcgttaacaaagggagccgataccgaccggcgtgggcgcggagcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgagatgagttttgatcatcctgagaaaaatgggccttggcctgcagacccaataaaccttccctcccatggataatagtgctaattcctgaggacctgaagggcctgccgcccctgggggattagccagaagcaggcttgttttcctgctcagaacaaagtgacttccctgaacacatcttcattatgattcacaccaacctgaagaaaaagttcagctgctgcgtcctggtctttcttctgtttgcagtcatctgtgtgtggaaggaaaagaagaaagggagttactatgattcctttaaattgcaaaccaaggaattccaggtgttaaagagtctggggaaattggccatggggtctgattcccagtctgtatcctcaagcagcacccaggacccccacaggggccgccagaccctcggcagtctcagaggcctagccaaggccaaaccagaggcctccttccaggtgtggaacaaggacagctcttccaaaaaccttatccctaggctgcaaaagatctggaagaattacctaagcatgaacaagtacaaagtgtcctacaaggggccaggaccaggcatcaagttcagtgcagaggccctgcgctgccacctccgggaccatgtgaatgtatccatggtagaggtcacagattttcccttcaatacctctgaatgggagggttatctgcccaaggagagcattaggaccaaggctgggccttggggcaggtgtgctgttgtgtcgtcagcgggatctctgaagtcctcccaactaggcagagaaatcgatgatcatgacgcagtcctgaggtttaatggggcacccacagccaacttccaacaagatgtgggcacaaaaactaccattcgcctgatgaactctcagttggttaccacagagaagcgcttcctcaaagacagtttgtacaatgaaggaatcctaattgtatgggacccatctgtataccactcagatatcccaaagtggtaccagaatccggattataatttctttaacaactacaagacttatcgtaagctgcaccccaatcagcccttttacatcctcaagccccagatgccttgggagctatgggacattcttcaagaaatctccccagaagagattcagccaaaccccccatcctctgggatgcttggtatcatcatcatgatgacgctgtgtgaccaggtggatatttatgagttcctcccatccaagcgcaagactgacgtgtgctactactaccagaagttcttcgatagtgcctgcacgatgggtgcctaccacccgctgctctatgagaagaatttggtgaagcatctcaaccagggcacagatgaggacatctacctgcttggaaaagccacactgcctggcttccggaccattcactgctaagcacaggctcctcactcttctccatcaggcattaaatgaatggtctcttggccaccccagcctgggaagaacattttcctgaacaattccagcctgctccttttactctaggggcctctgtcagcaagaccatggggacttcaagagcctgtggtcaggaaatcaggtccagccttccctgtagccagacagtttatgagcccagagcctcctgccacacacatgcacacatatctagcattctttccagacagcatcctccccgccttccaccttggtagatgcaaggtctatctctcccatcagggctgccaaagctgggctttgtttttcccagcagaatgatgccattctcacaaaccaatgctctatattgcttgaagtctgcatctaaatattgatttcacgttttaaagaaattctcttaaattacaattgtgcccaatgcagggtggctctggggggcaagtaggtggtacaggggattggaaacatgctccgcgcctccagagaaaagttgctcccgaggtccatgcccctggaacgtgttcctatcactctggctggttgggctggtccttagactgggtgcttatgattaaagggtcttggttagcccactttccctctccatgtggagatggaaggtagagaaggatacagtgtctatcctcaagttgctacggttcagtgagagaggcagacatctgaacaggcaggtaggattcagtgtgctcagtgcactggggatttggagagagatgggcttgctctctctgtgcacccaggagggccacgcacttaaaactgtgtttgtggatcagagaaggctttatagcacagggggcattcagatgagtcttagaggaagagaagaaacatggcaagcagattacatctgagccgtttgaattgtgtttttctttcttcccatgtttattttctaagatctacctgaacttagagactcaagatatttttttaggaaacctcctacccatgtctgaggtagcaagtgcagcctcacgacagataccaggcaatccagagccacaaaacgtgattcctccaggctctgcctggcctgaccctgtcctgtcagctgggtttacataccagtcccattcttccttttcaatacctacccccaaatcttctcctaaccaccatctgttttttttttttaaagcattttttgctttaaaagcatcctgaccccaatttctttgagctcacgggccttttgctgaaggtctctcagggtgtagtggtgtggctctctggacttaacgtcactctcagaggtcagaaccttggagatcagaactgattctcaccaggtgtgagaggtgtggtagcagattgcaatgctctgcacctcttccttgcaagtgagcaacttcaggctctctgggcagaggctggcccactgtagtttgcagacatgctctccagatggttttactaagtcccctctccctgatagggaatcctgctggaccagcgcagccctggtgtggagaggttaaaagacttgcacaggatcaccaagtcatgctgtagagccaggattcctagacccagggctctgcactctcaaggctggccccatgtgctcaaggggatctaatgtttgggctccaaactaaccatctcggagctgggctcctcatttactgccaaaccctcagcttatgtagctagaaagggccctggagtgagaaagcctggattttcaaattgatgctcccctactgactagctgtgccactctgggcaaatgctcttccttgagcctgtttccacacctgtaaagtggggatgatgatcctatctcactgcttttgtgaggattacaggaaagcacctgtcctggctctgtacctggcacgtagtaggtgctcagttcatgctggtttccttcctgcctttagtagggacctgctctgtgctcacacctcggctgcatgcaccctgctgtgacggaggctagtgtggaagaggtcctgtcctcagggaattaactgtcttattgggagacaacaactgtcctccttggaacacccaagaaaccatgcaaagcagtggacaacacagaacacgccctcctcctcgctgcctgcagctccaatctgattctgcttgggaatgggcggagcacgtgggctgcttaactgctgtataggacaagccccttacccctctctgggcccatgaattcctggcttggtttatgttctgatttgacacactgattttaatcttcgaatcatgacactgagtgcagaggaggtggcattccgacagcaggacatacatgttggtgtgaagactgggacgacactgggtagaatctagtttttaattattattaatataaaggatcaaattaatttaaatatgattctgaagtctacagaacttttagttctgtgctgtctatgtggacactttggtaaaatgcaaattatgatatggacgttatcattggtctggtgagatgtttcatatttgtgacagttaatttaaaaattatgagttaatgctgcctgtgtctatggggttctgtcttctttgatagccatctattcatctggatcatgggaccctctctaatccttccaccaatcaaataagctattgctattggtttggagttgagatatcagtctcggaaacttctgaaaaatgctaataattacccaaggattatgtcaaattttaaaataaatgtgtgtgtgtttctttaa

SEQ ID NO: 1347 - protein, 406 aa, Homo sapiens; identical to SEQ ID NO: 1345

SEQ ID NO: 1348 - DNA, 1440 bp, Homo sapiens
cagtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacaaaaaaaaaaaaaaaaaa

SEQ ID NO: 1349 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 1350 - DNA, 2645 bp, Homo sapiens
aggcaaccatgtggttccagctgaattttttttttccctctctctttcttcactcctttttctttccaaacagggaaaagtgttccacgaagcggtagcgcctttccgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaaaa

SEQ ID NO: 1351 - protein, 373 aa, Homo sapiens
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 1352 - DNA, 2485 bp, Homo sapiens
atgacagcctccgtgctcctccacccccgctggatcgagcccaccgtcatgtttctctacgacaacggcggcggcctggtggccgacgagctcaacaagaacatggaaggggcggcggcggctgcagcagcggctgcagcggcggcggctgccggggccgggggcgggggcttcccccacccggcggctgcggcggcagggggcaacttctcggtggcggcggcggccgcggctgcggcggcggccgcggccaaccagtgccgcaacctgatggcgcacccggcgcccttggcgccaggagccgcgtccgcctacagcagcgcccccggggaggcgcccccgtcggctgccgccgctgctgccgcggctgccgctgcagccgccgccgccgccgccgcgtcgtcctcgggaggtcccggcccggcgggcccggcgggcgcagaggccgccaagcaatgcagcccctgctcggcagcggcgcagagctcgtcggggcccgcggcgctgccctatggctacttcggcagcggctactacccgtgcgcccgcatgggcccgcaccccaacgccatcaagtcgtgcgcgcagcccgcctcggccgccgccgccgccgccttcgcggacaagtacatggataccgccggcccagctgccgaggagttcagctcccgcgctaaggagttcgccttctaccaccagggctacgcagccgggccttaccaccaccatcagcccatgcctggctacctggatatgccagtggtgccgggcctcgggggccccggcgagtcgcgccacgaacccttgggtcttcccatggaaagctaccagccctgggcgctgcccaacggctggaacggccaaatgtactgccccaaagagcaggcgcagcctccccacctctggaagtccactctgcccgacgtggtctcccatccctcggatgccagctcctataggagggggagaaagaagcgcgtgccttataccaaggtgcaattaaaagaacttgaacgggaatacgccacgaataaattcattactaaggacaaacggaggcggatatcagccacgacgaatctctctgagcggcaggtcacaatctggttccagaacaggagggttaaagagaaaaaagtcatcaacaaactgaaaaccactagttaatggattaaaaatagagcaagaaggcaacttgaagaaacgcttcagaactcgttgctttgcccagataatgataataatgcttaataataattgaagaatgggaaagagaaagagacagagactggcattttcctctcccgaaggagatctctttctctttaatggaatctacaactgttttaaaactttaagaaaggtaaagactgccagttcttccgccaaccccatcagcccagcccgttaaatgtcaaacgtcaacccccaaaatacgcaatttcagataagttacgcagttactgaaatcttgtaagtatttaagtgatcgttacattttaggacactgcgttagatggtaataatctggaagttggttacaaacgcaagaggccattgtaaacatctgcttgtccttcttaggtcgccattccctttgcatgttaagcgtctgctcaggtaaatcttagtgaaattcctaccgttgttgtacgttctgcaaaacattttatgtatagatttagaggggaaacgagaaggtactgaaataatgatcttggaatatttgctgtgaagggagaaagggagagaaaactcttctgaggatcatttgtcttggtagtatagtaaaaccaaccagctgaacctttcaggctacaagagaacccgggtcggtaatgtctttttaagaataatttttaattgcttataacaagcatattttgtggcatttgaactatatttactgctccaatatccgttattttccaaaggattttgtatctttttgaaaatgtttacatcatcagatgatccacagaattcactttatgtgagatctcccgagagtttccatcccaacataatggactttggtttgaacacaattcgttttttcatttgaattggcatttcccaatatttgctaaacatttgctggagaaatcatttttcttttttcttttttagaaaactcagaatgaaaattcattcccctgaaatatttaggtgtctatattctatattttgatctattaagggattagtatttttccatgtttattgtgttatcagagtgcattagaaagattagtgattcatcttcacagcacatttttaatcaagcagttatttcaaccagcacattcgttttgttcatattcactatagaatgatatcttgtaaataaagacattcagcacactgtgaaaatgtatttgtgcacctgctttttaaatatttctactaaaaatgaaaaaaaaaaacccttagacctgtagatagtgatatcgtaatattaattgttaataaaatagtcactgcc

SEQ ID NO: 1353 - protein, 388 aa, Homo sapiens
MTASVLLHPRWIEPTVMFLYDNGGGLVADELNKNMEGAAAAAAAAAAAAAAGAGGGGFPHPAAAAAGGNFSVAAAAAAAAAAAANQCRNLMAHPAPLAPGAASAYSSAPGEAPPSAAAAAAAAAAAAAAAAAASSSGGPGPAGPAGAEAAKQCSPCSAAAQSSSGPAALPYGYFGSGYYPCARMGPHPNAIKSCAQPASAAAAAAFADKYMDTAGPAAEEFSSRAKEFAFYHQGYAAGPYHHHQPMPGYLDMPVVPGLGGPGESRHEPLGLPMESYQPWALPNGWNGQMYCPKEQAQPPHLWKSTLPDVVSHPSDASSYRRGRKKRVPYTKVQLKELEREYATNKFITKDKRRRISATTNLSERQVTIWFQNRRVKEKKVINKLKTTS

SEQ ID NO: 1354 - DNA, 2402 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaaaaaaaaaaaaaaaaaaaa

SEQ ID NO: 1355 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 1356 - DNA, 1441 bp, Homo sapiens
ggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaaaaaaaaaaaaaaaaa

SEQ ID NO: 1357 - protein, 327 aa, Homo sapiens
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 1358 - DNA, 2358 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaaaaaaaaaaaaaaaaa

SEQ ID NO: 1359 - protein, 664 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 1360 - DNA, 3208 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 1361 - protein, 623 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGNLD

SEQ ID NO: 1362 - DNA, 1146 bp, Homo sapiens
ctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcatagtatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaaaaaaaaaaaaaaaaaaaaaaaa

SEQ ID NO: 1363 - protein, 226 aa, Homo sapiens
MELERIVSAALLAFVQTHLPEADLSGLDEVIFSYVLGVLEDLGPSGPSEENFDMEAFTEMMEAYVPGFAHIPRGTIGDMMQKLSGQLSDARNKENLQPQSSGVQGQVPISPEPLQRPEMLKEETRSSAAAAADTQDEATGAEEELLPGVDVLLEVFPTCSVEQAQWVLAKARGDLEEAVQMLVEGKEEGPAAWEGPNQDLPRRLRGPQKDELKSFILQKYMMVDSA

SEQ ID NO: 1364 - DNA, 1618 bp, Homo sapiens
ggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatctacccggtgaaatcctgcaaaggggtgccggtgagcgaggctgagtgcacggccatggggctgcgcagcggcaacctgcgggacaggttttggctggtgattaaggaagatggacacatggtcactgcccgacaggagcctcgcctcgtgctcatctccatcatttatgagaataactgcctgatcttcagggctccagacatggaccagctggttttgcctagcaagcagccttcctcaaacaaactccacaactgcaggatatttggccttgacattaaaggcagagactgtggcaatgaggcagctaagtggttcaccaacttcttgaaaactgaagcgtatagattggttcaatttgagacaaacatgaagggaagaacatcaagaaaacttctccccactcttgatcagaatttccaggtggcctacccagactactgcccgctcctgatcatgacagatgcctccctggtagatttgaataccaggatggagaagaaaatgaaaatggagaatttcaggccaaatattgtggtgaccggctgtgatgcttttgaggaggatacctgggatgaactcctaattggtagtgtagaagtgaaaaaggtaatggcatgccccaggtgtattttgacaacggtggacccagacactggagtcatagacaggaaacagccactggacaccctgaagagctaccgcctgtgtgatccttctgagagggaattgtacaagttgtctccactttttgggatctattattcagtggaaaaaattggaagcctgagagttggtgaccctgtgtatcggatggtgtagtgatgagtgatggatccactagggtgatatggcttcagcaaccaggagggattgactgagatcttaacaacagcagcaacgatacatcagcaaatccttattatccagccttcaactatctttaccctggaaaacaatctcgatttttgacttttcaaagttgtgtatgctccaggttaatgcaaggaaagtattagaggggggaatatgaaagtatatatataaattttaggtactgaaggctttaaaaataattaagatcatcaaaaatgctattttgaatgttatcatggctattacacttttacttcctgactttaatattgatgaataaagcaagtttaatgaatcaactaaaaagctgcaaaaaaaaaaaaaaaaaaaaaaaaaaaaaaaaaaaaaaaaaaaaaaa

SEQ ID NO: 1365 - protein, 335 aa, Homo sapiens
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 1366 - DNA, 1122 bp, Homo sapiens
gctcctcgccccgcgcctgcccccaggatggtccgcgcgaggcaccagccgggtgggctttgcctcctgctgctgctgctctgccagttcatggaggaccgcagtgcccaggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttcacatagcctttgtgcaaaaaaaaaaaaaaaaaaaaa

SEQ ID NO: 1367 - protein, 344 aa, Homo sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 1368 - DNA, 2443 bp, Homo sapiens
aaatggcgtgcccgtctctccgccggccccctgcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgaaaaaaaa

SEQ ID NO: 1369 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 1370 - DNA, 2539 bp, Homo sapiens
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 1371 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLMDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 1372 - DNA, 3877 bp, Homo sapiens
ctccttaggtggaaaccctgggagtagagtactgacagcaaagaccgggaaagaccatacgtccccgggcaggggtgacaacaggtgtcatctttttgatctcgtgtgtggctgccttcctatttcaaggaaagacgccaaggtaattttgacccagaggagcaatgatgtagccacctcctaaccttcccttcttgaacccccagttatgccaggatttactagagagtgtcaactcaaccagcaagcggctccttcggcttaacttgtggttggaggagagaacctttgtggggctgcgttctcttagcagtgctcagaagtgacttgcctgagggtggaccagaagaaaggaaaggtcccctcttgctgttggctgcacatcaggaaggctgtgatgggaatgaaggtgaaaacttggagatttcacttcagtcattgcttctgcctgcaagatcatcctttaaaagtagagaagctgctctgtgtggtggttaactccaagaggcagaactcgttctagaaggaaatggatgcaagcagctccgggggccccaaacgcatgcttcctgtggtctagcccagggaagcccttccgtgggggccccggctttgagggatgccaccggttctggacgcatggctgattcctgaatgatgatggttcgccgggggctgcttgcgtggatttcccgggtggtggttttgctggtgctcctctgctgtgctatctctgtcctgtacatgttggcctgcaccccaaaaggtgacgaggagcagctggcactgcccagggccaacagccccacggggaaggaggggtaccaggccgtccttcaggagtgggaggagcagcaccgcaactacgtgagcagcctgaagcggcagatcgcacagctcaaggaggagctgcaggagaggagtgagcagctcaggaatgggcagtaccaagccagcgatgctgctggcctgggtctggacaggagccccccagagaaaacccaggccgacctcctggccttcctgcactcgcaggtggacaaggcagaggtgaatgctggcgtcaagctggccacagagtatgcagcagtgcctttcgatagctttactctacagaaggtgtaccagctggagactggccttacccgccaccccgaggagaagcctgtgaggaaggacaagcgggatgagttggtggaagccattgaatcagccttggagaccctgaacaatcctgcagagaacagccccaatcaccgtccttacacggcctctgatttcatagaagggatctaccgaacagaaagggacaaagggacattgtatgagctcaccttcaaaggggaccacaaacacgaattcaaacggctcatcttatttcgaccattcagccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatgaactcccagagaaggattgtgggagacactttttctttccttttgcaattactgaaagtggctgcaacagagaaaagacttccataaaggacgacaaaagaattggactgatgggtcagagatgagaaagcctccgatttctctctgttgggctttttacaacagaaatcaaaatctccgctttgcctgcaaaagtaacccagttgcaccctgtgaagtgtctgacaaaggcagaatgcttgtgagattataagcctaatggtgtggaggttttgatggtgtttacaatacactgagacctgttgttttgtgtgctcattgaaatattcatgatttaagagcagttttgtaaaaaattcattagcatgaaaggcaagcatatttctcctcatatgaatgagcctatcagcagggctctagtttctaggaatgctaaaatatcagaaggcaggagaggagataggcttattatgatactagtgagtacattaagtaaaataaaatggaccagaaaagaaaagaaaccataaatatcgtgtcatattttccccaagattaaccaaaaataatctgcttatctttttggttgtccttttaactgtctccgtttttttcttttatttaaaaatgcactttttttcccttgtgagttatagtctgcttatttaattaccactttgcaagccttacaagagagcacaagttggcctacatttttatattttttaagaagatactttgagatgcattatgagaactttcagttcaaagcatcaaattgatgccatatccaaggacatgccaaatgctgattctgtcaggcactgaatgtcaggcattgagacatagggaaggaatggtttgtactaatacagacgtacagatactttctctgaagagtattttcgaagaggagcaactgaacactggaggaaaagaaaatgacactttctgctttacagaaaaggaaactcattcagactggtgatatcgtgatgtacctaaaagtcagaaaccacattttctcctcagaagtagggaccgctttcttacctgtttaaataaaccaaagtataccgtgtgaaccaaacaatctcttttcaaaacagggtgctcctcctggcttctggcttccataagaagaaatggagaaaaatatatatatatatatatatattgtgaaagatcaatccatctgccagaatctagtgggatggaagtttttgctacatgttatccaccccaggccaggtggaagtaactgaattattttttaaattaagcagttctactcaatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgaa

SEQ ID NO: 1373 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNNPAENSPNHRPYTASDFIEGIYRTERDKGTLYELTFKGDHKHEFKRLILFRPFSPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 1374 - DNA, 4620 bp, Homo sapiens
ccggaggatgtgcagctgcggcggcggcgccggctacgaagaggacggggacaggcgccgtgcgaaccgagcccagccagccggaggacgcgggcagggcgggacgggagcccggactcgtctgccgccgccgtcgtcgccgtcgtgccggccccgcgtccccgcgcgcgagcgggaggagccgccgccacctcgcgcccgagccgccgctagcgcgcgccgggcatggtcccctcttaaaggcgcaggccgcggcggcgggggcgggcgtgcggaacaaagcgccggcgcggggcctgcgggcggctcgggggccgcgatgggcgcggcgggcccgcggcggcggcggcgctgcccgggccgggcctcgcggcgctagggcgggctggcctccgcgggcgggggcagcgggctgagggcgcgcggagcctgcggcggcggcggcggcggcggcggcggcccggcgggcggagcggcgcgggcatggccgcgcgcggccggcgcgcctggctcagcgtgctgctcgggctcgtcctgggcttcgtgctggcctcgcggctcgtcctgccccgggcttccgagctgaagcgagcgggcccacggcgccgcgccagccccgagggctgccggtccgggcaggcggcggcttcccaggccggcggggcgcgcggcgatgcgcgcggggcgcagctctggccgcccggctcggacccagatggcggcccgcgcgacaggaactttctcttcgtgggagtcatgaccgcccagaaatacctgcagactcgggccgtggccgcctacagaacatggtccaagacaattcctgggaaagttcagttcttctcaagtgagggttctgacacatctgtaccaattccagtagtgccactacggggtgtggacgactcctacccgccccagaagaagtccttcatgatgctcaagtacatgcacgaccactacttggacaagtatgaatggtttatgagagcagatgatgacgtgtacatcaaaggagaccgtctggagaacttcctgaggagtttgaacagcagcgagcccctctttcttgggcagacaggcctgggcaccacggaagaaatgggaaaactggccctggagcctggtgagaacttctgcatgggggggcctggcgtgatcatgagccgggaggtgcttcggagaatggtgccgcacattggcaagtgtctccgggagatgtacaccacccatgaggacgtggaggtgggaaggtgtgtccggaggtttgcaggggtgcagtgtgtctggtcttatgagatgcagcagcttttttatgagaattacgagcagaacaaaaaggggtacattagagatctccataacagtaaaattcaccaagctatcacattacaccccaacaaaaacccaccctaccagtacaggctccacagctacatgctgagccgcaagatatccgagctccgccatcgcacaatacagctgcaccgcgaaattgtcctgatgagcaaatacagcaacacagaaattcataaagaggacctccagctgggaatccctccctccttcatgaggtttcagccccgccagcgagaggagattctggaatgggagtttctgactggaaaatacttgtattcggcagttgacggccagccccctcgaagaggaatggactccgcccagagggaagccttggacgacattgtcatgcaggtcatggagatgatcaatgccaacgccaagaccagagggcgcatcattgacttcaaagagatccagtacggctaccgccgggtgaaccccatgtatggggctgagtacatcctggacctgctgcttctgtacaaaaagcacaaagggaagaaaatgacggtccctgtgaggaggcacgcgtatttacagcagactttcagcaaaatccagtttgtggagcatgaggagctggatgcacaagagttggccaagagaatcaatcaggaatctggatccttgtcctttctctcaaactccctgaagaagctcgtcccctttcagctccctgggtcgaagagtgagcacaaagaacccaaagataaaaagataaacatactgattcctttgtctgggcgtttcgacatgtttgtgagatttatgggaaactttgagaagacgtgtcttatccccaatcagaacgtcaagctcgtggttctgcttttcaattctgactccaaccctgacaaggccaaacaagttgaactgatgagagattaccgcattaagtaccctaaagccgacatgcagattttgcctgtgtctggagagttttcaagagccctggccctggaagtaggatcctcccagtttaacaatgaatctttgctcttcttctgcgacgtcgacctcgtgtttactacagaattccttcagcgatgtcgagcaaatacagttctgggccaacaaatatattttccaatcatcttcagccagtatgacccaaagattgtttatagtgggaaagttcccagtgacaaccattttgcctttactcagaaaactggcttctggagaaactatgggtttggcatcacgtgtatttataagggagatcttgtccgagtgggtggctttgatgtttccatccaaggctgggggctggaggatgtggaccttttcaacaaggttgtccaggcaggtttgaagacgtttaggagccaggaagtaggagtagtccacgtccaccatcctgtcttttgtgatcccaatcttgaccccaaacagtacaaaatgtgcttggggtccaaagcatcgacctatgggtccacacagcagctggctgagatgtggctggaaaaaaatgatccaagttacagtaaaagcagcaataataatggctcagtgaggacagcctaatgtccagctttgctggaaaagacgtttttaattatctaatttatttttcaaaaattttttgtatgatcagtttttgaagtccgtatacaaggatatattttacaagtggttttcttacataggactcctttaagattgagctttctgaacaagaaggtgatcagtgtttgcctttgaacacatcttcttgctgaacattatgtagcagacctgcttaactttgacttgaaatgtacctgatgaacaaaacttttttaaaaaaatgttttcttttgagaccctttgctccagtcctatggcagaaaacgtgaacattcctgcaaagtattattgtaacaaaacactgtaactctggtaaatgttctgttgtgattgttaacattccacagattctaccttttgtgttttgttttttttttttacaattgttttaaagccatttcatgttccagttgtaagataaggaaatgtgataatagctgtttcatcattgtcttcaggagagctttccagagttgatcatttcccctcatggtactctgctcagcatggccacgtaggttttttgtttgttttgttttgttctttttttgagacggagtctcactctgttacccaggctggaatgcagtggcgcaatcttggctcactttaacctccacttccctggttcaagcaattcccctgcctttgcctcccgagtagctgggattacaggcacacaccaccacgcccagctagtttttttgtatttttagtagagacggggtttcaccatgcaagcccagctggccacgtaggttttaaagcaaggggcgtgaagaaggcacagtgaggtatgtggctgttctcgtggtagttcattcggcctaaatagacctggcattaaatttcaagaaggatttggcattttctcttcttgacccttctctttaaagggtaaaatattaatgtttagaatgacaaagatgaattattacaataaatctgatgtacacagactgaaacacacacacatacaccctaatcaaaacgttggggaaaaatgtatttggttttgttcctttcatcctgtctgtgttatgtgggtggagatggttttcattctttcattactgttttgttttatcctttgtatctgaaatacctttaatttatttaatatctgttgttcagagctctgccatttcttgagtacctgttagttagtattatttatgtgtatcgggagtgtgtttagtctgttttatttgcagtaaaccgatctccaaagatttccttttggaaacgctttttcccctccttaatttttatattccttactgttttactaaatattaagtgttctttgacaattttggtgctcatgtgttttggggacaaaagtgaaatgaatctgtcattataccagaaagttaaattctcagatcaaatgtgccttaataaatttgttttcatttagatttcaaacagtgatagacttgccattttaatacacgtcattggagggctgcgtatttgtaaatagcctgatgctcatttggaaaaataaaccagtgaacaatatttttctattgtacttttcgaaccattttgtctcattattcctgttttagctgaagaattgtattacatttggagagtaaaaaacttaaacacgaaaaaaaaaaaaaaaaaaaaaaaaaaaaaaaaaaaaaaaaaaaaaaaaaaaaaaaaaaaaaaaaaaaa

SEQ ID NO: 1375 - protein, 802 aa, Homo sapiens
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 1376 - DNA, 2055 bp, Homo sapiens
ggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaa

SEQ ID NO: 1377 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 1378 - DNA, 3257 bp, Homo sapiens
ggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttaaaaaaaaaaaaaaaaaaaaaaaaaaaa

SEQ ID NO: 1379 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 1380 - DNA, 2379 bp, Homo sapiens
gagagtcggcgcccgcaacgcggagccgggaagtcgtcgctactctggtggaactcagagttggttctggaggcggcggacgcggaggtccctcagaggatccagcgaggggcgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacgaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaaaa

SEQ ID NO: 1381 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 1382 - DNA, 1804 bp, Homo sapiens
ggggccgggcggggccagcggcgcattagcgccttgtcaattcggctgctcagacttgctccggcctccgcgtccgcgcccagcgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaa

SEQ ID NO: 1383 - protein, 422 aa, Homo sapiens
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 1384 - DNA, 2099 bp, Homo sapiens
gaaagaaacaacaactggaaaagaagcattgcataagaccaggatgtctctgaaatggatgtcagtctttctgctgatgcagctcagttgttactttagctctgggagttgtggaaaggtgctggtgtggcccacagaatacagccattggataaatatgaagacaatcctggaagagcttgttcagaggggtcatgaggtgattgtgttgacatcttcggcttctattcttgtcaatgccagtaaatcatctgctattaaattagaagtttatcctacatctttaactaaaaatgatttggaagatttttttatgaaaatgttcgatagatggacatatagtatttcaaaaaatacattttggtcatatttttcacaactacaagaattgtgttgggaatattctgactataatataaagctctgtgaagatgcagttttgaacaagaaacttatgagaaaactacaagagtcaaaatttgatgtccttctggcagatgccgttaatccctgtggtgagctgctggctgaactacttaacataccctttctgtacagtctccgcttctctgttggctacacagttgagaagaatggtggaggatttctgttccctccttcctatgtacctgttgttatgtcagaattaagtgatcaaatgattttcatggagaggataaaaaatatgatatatatgctttattttgacttttggtttcaagcatatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccttgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtataagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctatctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagcctgaagtggaatgaccaaaagatgggactcctcctttattccagcatggagggttttaaatggaggatttcctttttcctgcgacaaaacgtcttttcacaacttaccctgttaagtcaaaatttattttccaggaatttaatatgtactttagttggaattattctatgtcaatgatttttaagctatgaaaaataataatataaaaccttatgggcttatattgaaatttattattctaatccaaaagttaccccacacaaaagttactgagcttccttatgtttcacacattgtatttgaacacaaaacattaacaactccactcatagtatcaacattgttttgcaaatactcagaatattttggcttcattttgagcagaatttttgtttttaattttgccaatgaaatcttcaataattaaaaaaaaaaaaaaaaaaaaaaaaa

SEQ ID NO: 1385 - protein, 530 aa, Homo sapiens
MSLKWMSVFLLMQLSCYFSSGSCGKVLVWPTEYSHWINMKTILEELVQRGHEVIVLTSSASILVNASKSSAIKLEVYPTSLTKNDLEDFFMKMFDRWTYSISKNTFWSYFSQLQELCWEYSDYNIKLCEDAVLNKKLMRKLQESKFDVLLADAVNPCGELLAELLNIPFLYSLRFSVGYTVEKNGGGFLFPPSYVPVVMSELSDQMIFMERIKNMIYMLYFDFWFQAYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPIYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 1386 - DNA, 3084 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggtt

SEQ ID NO: 1387 - protein, 818 aa, Homo sapiens
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMVSKFYGI

SEQ ID NO: 1388 - DNA, 4465 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1389 - protein, 685 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1390 - DNA, 5260 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1391 - protein, 950 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1392 - DNA, 4468 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1393 - protein, 686 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1394 - DNA, 2545 bp, Homo sapiens
cacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggaccagcggccccgccagcggccacgccctccgaattctcaccgcaccccgagacctgccccttgctcgccacgccagcctgcgcctgctcagcgatccccgctccggggagcctctggaccgcgcactggtgctctggttcccaggtccccagagtttcaccggtgaggactgcgtggagttccacgtgcatggaggcccggcagtggtgagcggcgtcctgcaggccttgggcagcgtgccagggcttcgaccggcggaggcaggcgagttcactagacgggcgttcgccaatgggaagctgaacctgaccgaagtggaggggctggcggaccttatccacgcggaaacagaggcgcagcggcggcaggccctcaggcagctggacggagagctgggccacctctgccgtggctgggccgagaccctcaccaaagctctggcccacgtggaggcctatatcgatttcggcgaggatgacaacctggaggagggggtcctggagcaagccgacatcgaagtacgggcactgcaggtggccctgggtgcacatctacgagatgccaggcgcgggcagaggctccgctcaggggcgcacgtagtggtcactggaccccccaatgcgggcaagagcagcctagtgaacctgctcagtcggaagcctgtgtccatcgtgtccccggagccagggaccacccgtgacgtgctggagaccccagtcgacctggccggatttcctgtgctgctgagcgacacggctgggttgcgggagggcgtggggcccgtggagcaggagggcgtgcggcgcgcccgggagaggctagagcaggctgacctcattctggccatgctggatgcttctgacctggcctctccctccagttgcaacttcctggccaccgtcgtagcctctgtgggagcccagagccccagtgacagcagccagcgcctcctcctggtgctgaacaagtcggacctgctgtccccggagggcccaggtcccggtcctgacctgcccccgcacctgctgctgtcctgtctgacgggagaggggctggacggcctcctggaggcgctgaggaaggagctagctgcagtgtgtggggacccgtccacagatcccccgctgctgacccgagcaaggcaccagcaccacctccagggttgcctggatgccctcggccactacaagcagtcaaaagacctggccctggcggcagaggcgctgcgggtggcccggggtcacctgacccggctcacaggtggagggggtaccgaggagatcctggacatcatcttccaggacttctgtgtgggcaagtgacgggatccagggaagtcgcacccaagctgcgtggagacccaggagcctcgggggatctggaaacagtttaggccaattgggattctcattcgcctgggaaagaacttgattctcaaatagtgaagcaacacagctgagaggtagtgagatccctgcagggactccctggagattcaggccctggaatggggctgaatggaggtcccgttcgacccttgatgctggggcatccgggttgggatggagataggaggatctcagtatatttgtttcgtagttttttatttattttgcaaataccaaaggaatgtaaaaaaaactcaggtgatctagaagtgtttattttcttcccttcccttcccttccctttccttttccctttccctttccccttccccttccccttccccttccccttcccctacccttccctcctctgtctattgcccaggctggagtgcagtggtgcgaccttggctcactgcaacctccatctccggggctcaagcgcttctcctgcctcagcctcctgagtagctgggattacaggcatgtgccagcatgcccggctaatttttttctttttttgagacagagtctcgctctgtcacccaggctggagttcagtggtgcgacctcggcttactgcaacctccacctcccgggttcaagtgattctcctgcctcagcctcttgagtagctgggactacaggcgcacaccaccacgccaggctaatttttgtatttttagtagagacaaggtttcaccatgttgaccaggctggtcttgaactccttgacctcaggtaatctgcctaccttggcctcccaaagtgctgggatcacaggcgtgagctatcacacctggccccagaagtgtttcaacatggaaattttccttagcccttctgtggttgtcatggcttaatgtgtgtctttccagaactttgaatgtttgcatacttgtggatgtacctttcaaatatgtttgtcttgtgtatcatatataaatggtattgtgtt

SEQ ID NO: 1395 - protein, 492 aa, Homo sapiens
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQADIEVRALQVALGAHLRDARRGQRLRSGAHVVVTGPPNAGKSSLVNLLSRKPVSIVSPEPGTTRDVLETPVDLAGFPVLLSDTAGLREGVGPVEQEGVRRARERLEQADLILAMLDASDLASPSSCNFLATVVASVGAQSPSDSSQRLLLVLNKSDLLSPEGPGPGPDLPPHLLLSCLTGEGLDGLLEALRKELAAVCGDPSTDPPLLTRARHQHHLQGCLDALGHYKQSKDLALAAEALRVARGHLTRLTGGGGTEEILDIIFQDFCVGK

SEQ ID NO: 1396 - DNA, 1899 bp, Homo sapiens
gtccgtactgcagagccgctgccggagggtcgttttaaagggccgcgttgccgccccctcggcccgccatgctgctatccgtgccgctgctgctcggcctcctcggcctggccgtcgccgagcccgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatcctttgattctccttcagccctcacccctggttctcatctttcttgatcaacatcttttcttgcctctgtgccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctc

SEQ ID NO: 1397 - protein, 417 aa, Homo sapiens
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 1398 - DNA, 1809 bp, Homo sapiens
gtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaaaaaa

SEQ ID NO: 1399 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 1400 - DNA, 2475 bp, Homo sapiens
atgttgttctcctggcgagaagatcctggagcccagtgcctgctgctttctcttctgctcctcgcagcctcggaggtggggagcggccagctccactactccgtctctgaggaggccaagcatggcaccttcgtgggccgcatcgcgcaggacctggggctggagctggcggagctggtgccgcgcctgttccgggtggcgtccaaaagacacggggaccttctggaggtaaatctgcagaatggcattttgtttgtgaattctcggatagaccgcgaggaactgtgcgggcggagcgcggagtgcagcatccacctggaggtgatcgtggacaggccgctgcaggttttccatgtggaggtggaagtgaaggacattaatgacaacgcgccagtttttccaatggctgtaaagaatctgtttatttccgaatcccgacagcctggctctcggttttcgctagagggcgcatcagatgcagatatcggaacaaattcgttgttgacttacagtcttgattccactgaatattttaccttggacgttaaaagaaatgatgaggaaattaaatcccttggactcgtgttgaaaaaaaatttaaatcgagaggacactcctaagcattatttactaataacagcaattgatggtgggaaaccagagctcactggcacgactcaactaaagatcactgttttagatgtaaacgacaacgccccagcgtttgagaggacgatctataaagtcagattactcgaaaatgcaccaaatggtaccctagtggtgaccgttaacgccaccgatttggatgaaggagtaaataaggatatcgcgtattctttcaatacggacatgtcagcagatattctgtcaaaattccatttagatccagtcaatggacaaatcagtgtaaagggtaacatagatttcgaggaaagtaagtcatatgaaatccaggtagaagccacggataaaggaaatcccccaatgtcagatcactgcacagttctactcgaaattgtggacatcaatgataatgtacctgagttagttattcaatcactatctttacctgtattagaagactctccacttagcacagtcatcgctctgatcagcgtgtccgaccgcgactcaggagtcaatggacaggtcacctgctcgctgacgccccacgtccccttcaagctggtgtccaccttcaagaattactactcattggtgctggacagccctctggaccgcgagagcgtgtcggcctatgagctggtggtgactgctcgggacgggggctcgccttcactgtgggccacggccagcgtgtccgtggaggtggccgacgtgaacgacaatgcgccggcattctcgcagtccgagtacacggtgttcgtgaaggagaacaacccgccgggctgccacatcttcacggtgtctgcgcgggacgcggacgcgcaggagaacgccctggtgtcctactcgctggtggaacggcgggtgggggagcgcgcgctgtcgagctacgtgtcggtacacgcggagagcggcaaggtgtacgcgctgcagccgctggaccacgaggagctagagctgctgcagttccaggtgagtgcgcgcgatgcgggcgtgccgcctctgggcagcaacgtgacgctgcaggtgttcgtgctggacgagaacgacaacgcgccggcactgctgatgcctcgggtgggtggcatcggtggcgcagtgagcgagctggtgccgcggtcagtgggtgcgggccacgtggtagcgaaggtgcgcgcagtggatgcagactcaggctacaacgcgtggctttcgtatgagctgcagcctgggaccggcggtgcgcgcatcccgtttcgcgtggggctgtacacgggagagatcagcacgacccgtgccctggacgaggtggacgccccgcgccatcgcctactggtgctggtgaaggaccacggtgaaccctcattgaccgccacggccactgtgctggtgtcgctggtggagagtggccaggcacccaaggcctcgtcccaggcgtccgctggcgccacgggcccggaagctgcactggtggatgtcaacgtgtacttgatcgtcgccatctgcgcggtgtccagtctgttggtgctcacactgctgctatatactgctctgcggtgctccgcgccgccaaccgaaggcgactgtgggccgggcaagcccacgctggtgtgctccagcgcggtggggagctggtcatactcgcagcagaggcagcagagggtgtgctctggagaggggttgcccaagaccgacctcatggcttttagccctagccttcctccttgtccaattagccgggatagagaggagaaacaggatgtggacgttgatctctcagccaaagtgagtaatttttatttattctttccaaaatgtctttgtttttcattcctcaatgtttccactcctctggaaatacattaa

SEQ ID NO: 1401 - protein, 824 aa, Homo sapiens
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKVSNFYLFFPKCLCFSFLNVSTPLEIH

SEQ ID NO: 1402 - DNA, 3003 bp, Homo sapiens
gggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcacctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacgtacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatggtaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaat

SEQ ID NO: 1403 - protein, 509 aa, Homo sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLHLAPDGRTCVDVDECATGRASCPRFRQCVNTFGSYICKCHKGFDLMYIGGKYQCHDIDECSLGQYQCSSFARCYNVRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSESQR

SEQ ID NO: 1404 - DNA, 3630 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcctttccttggcctgatccttgtctgccttcacttccctaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacacagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgacggcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 1405 - protein, 197 aa, Homo sapiens
MRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 1406 - DNA, 2571 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatgtaagtccaactttcgagttttggctttaaatatttttcatatttaacttgtctaatcatcttttcaaatatcactttaaaaaatgtcttcaaggtgttcactaacgttgaaataaatcataccattgaatgtagatatcctattaatggcagttttgtcttgaatggaactagaaa

SEQ ID NO: 1407 - protein, 807 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNVSPTFEFWL

SEQ ID NO: 1408 - DNA, 2455 bp, Homo sapiens
gaattcgggcgggcttcttcgctgccgacgtacgacgagtggccgggctcttgcgtctggtaacgcgctgtctctaacgccagcgccgtctcgcgcgcactgcgcacagaccacccgcagacgcccggcagtccgcaggcccaaacgcgcacgcgaccccgctctccgcaccgtacccggccgcctcggcatggcgccccgcagcgcccggcgacccctgctgctgctactgcctgttgctgctgctcggcctcatgcattgtcgtcagcagccatgtttatggtgaaaaatggcaacgggaccgcgtgcataatggccaacttctctgctgccttctcagtgaactacgacaccaagagtggccccaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgttcagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcacgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctgcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcattgagtttagggttctggtgtttggtttcttcattctttactgcactcagatttaagccttacaaagggaaacctctggccgtcacacgtaggacgcatgaaggtcactcgtgtgaggctgacatgctcacacattacaacagtagagagggaaaatcctaagacagaggaactccagagatgagtgtctggagcggcttcagttcagctttaaaggccaggacgcgcgacacgtggctggcggcctcgttccagtggcggcacgtccttggcgtctctaatgtctgcagctcaagggctggcacttttttaaatataaaaatggtgttatttttatttttttttgtaaagtgatttttggtcttctgttgacattcgggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttcaaaaaaaccccgaattc

SEQ ID NO: 1409 - protein, 416 aa, Homo sapiens
MAPRSARRPLLLLLPVAAARPHALSSAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSTLIPIAVGGALAGLVLIVLIAYLVGRKRSHAGYQTI

SEQ ID NO: 1410 - DNA, 3399 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacacagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgacggcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 1411 - protein, 192 aa, Homo sapiens
MRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 1412 - DNA, 3127 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgagctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacacagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgacggcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 1413 - protein, 113 aa, Homo sapiens
MRHNWTPDLSPLWVLLLCAHVVTLLVRATPVSQTTTAATASVRSTKDPCPSQPPVFPAAKQCPALEVTWPEVEVPLSWAEGNLAPHPRSPALQPQQSTAAGLRLSTGPAAAQP

SEQ ID NO: 1414 - DNA, 3070 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagatatggaacttcaatcttcaaatccagcttgcctcttgaaactattgtctaacaagactcttggcaaagacattttgaagactttggaattttcacttcacagatgtactgatgctatgccaaataaatattgaatagctaccaaataaacattgttttctattctgctgcattccccatctgtacattaaaatacctggtaaatgaaaatattacaaatgaaatgggtgaaaatggaattcttcctccttttttccaatgtgcttgatgtcaatgatcattttgtaaaaatatagtttgggtccccacatagtgaaagtactctggtttctgtttgattcagaaatttggtgggttttttgttgttgttttggtttttgtgtgtgtgtgtttgtgtgagtgtagttcttcaatagagagggagcgtaaagctattttcactagattgattttttgtttagacaaacaggatgaaaataactttatggatataggaggcaaggaaagtttttaaatggctaccattatgtctttatatattaaatttctttatgtaagaaaaaaaaaaaaaaaaaa

SEQ ID NO: 1415 - protein, 808 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKIWNFNLQIQLAS

SEQ ID NO: 1416 - DNA, 6093 bp, Homo sapiens
gcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtctcggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactata

SEQ ID NO: 1417 - protein, 775 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 1418 - DNA, 2506 bp, Homo sapiens
tgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaagtaagttattaa

SEQ ID NO: 1419 - protein, 792 aa, Homo sapiens
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEVSY

SEQ ID NO: 1420 - DNA, 4495 bp, Homo sapiens
atggaaataaaaccagaggtatttgacatggtgtttaccccggaggatagattgggaaagcaatgtctgctcctcccgcttctgctcctcgcagcctggaaggtggggagcggccagctccactactccgtacccgaggaggccaaacacggcaccttcgtgggccggatcgcgcaggacctggggctggagctggcggagctggtgccgcgcctgttcaggatggcctccaaagaccgcgaggaccttctggaggtaaatctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgagggacattaacgacaacccgcccttgttcccggtagaggaacaaagagtgctgatttacgaatctaggctgccagattctgtgtttccactggagggcgcgtccgatgcagatgttggctcaaattccatcttaacctataaactcagttctagcgaatacttcgggctagatgtgaaaataaacagtgatgacaataaacaaattgggctcttattaaagaaatccttggacagagaggaagctcctgcacacaacttattcctgacagccacagatgggggcaaacctgagctcacaggcactgttcagctgctggtcacagtgctggatgtgaatgataatgctcccactttcgaacagtctgaatacgaagtaagaatattcgaaaatgcagacaacggaacaacagttatcagactgaatgcttctgatcgggatgaaggagcgaatggggcaatttcatattcttttaatagccttgttgcagccatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgaactgctcgctgacgcctcacgtccctttcaagctggtgtccaccttcaagaattactactcgttggtgctggacagtgccctggaccgcgagagcgtgtcggcctatgagttggtggtaaccgcgcgggacgggggctcgccttcgctgtgggccaccgccagcttgtctgtggaggtggccgacatgaatgacaatgctccggcgttcgcgcagcccgagtacacagtgttcgtgaaggagaacaacccgccgggctgccacatcttcacggtgtctgcgcgagacgcggacgcgcaggagaacgcgctggtgtcctactcgctggtggagcggcgggtgggcgagcgcgcgttgtcgagctacatttcggtgcacgcggagagcggcaaggtgtacgcgctgcagccgctggaccacgaggagctagagctgctgcagtttcagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1421 - protein, 686 aa, Homo sapiens
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1422 - DNA, 6345 bp, Homo sapiens
gtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatggaaaaaaaaaaaaaaaaaaaaaaaaaaaaaa

SEQ ID NO: 1423 - protein, 437 aa, Homo sapiens
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 1424 - DNA, 2427 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagaggtaagcttatattttaaaaaattgtcttagtaa

SEQ ID NO: 1425 - protein, 807 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEVSLYFKKLS

SEQ ID NO: 1426 - DNA, 2043 bp, Homo sapiens
cgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggttttggcttgtgatcaaccaggagggaaacatggttactgctcgccaggaacctcgcctggtcctgatttccctgacctgcgatggtgacaccctgactctcagtgcagcctacacaaaggacctactactgcctatcaaaacgcccaccacaaatgcagtgcacaagtgcagagtgcacggcctggagatagagggcagggactgtggcgaggccgccgcccagtggataaccagcttcctgaagtcacagccctaccgcctggtgcacttcgagcctcacaagcgaccgagacgtcctcatcaaatagcagacttgttccgacccaaggaccagattgcttactcagacaccagcccattcttgatcctttctgaggcgtcgctggcggatctcaactccaggctagagaagaaagttaaagcaaccaacttcaggcccaatattgtaatttcaggatgcgatgtctatgcagaggattcttgggatgagcttcttattggtgacgtggaactgaaaagggtgatggcttgttccagatgcattttaaccacagtggacccagacaccggtgtcatgagcaggaaggaaccgctggaaacactgaagagttatcgccagtgtgacccttcagaacgaaagttatatggaaaatcaccactctttgggcagtattttgtgctggaaaacccagggaccatcaaagtgggagaccctgtgtacctgctgggccagtaatgggaaccgtatgtcctggaatattagatgccttttaaaaatgttctcaaaaatgacaacacttgaagcatggtgtttcagaactgagacctctacattttctttaaatttgtgattttcacatttttcgtcttttggacttctggtgtctcaatgcttcaatgtcccagtgcaaaaagtaaagaaatatagtctcaataacttagtaggacttcagtaagtcacttaaatgacaagacaggattctgaaaactccccgtttaactgattatggaatagttctttctcctgcttctccgtttatctaccaagagcgcagacttgcatcctgtcactaccactcgttagagaaagagaagaagagaaagaggaagagtgggtgggctggaagaatgtcctagaatgtgttattgcccctgttcatgaggtacgcaatgaaaattaaattgcaccccaaatatggctggaatgccacttcccttttcttctcaagccccgggctagcttttgaaatggcataaagactgaggtgaccttcaggaagcactgcagatattaattttccatagatctggatctggccctgctgcttctcagacagcattggatttcctaaaggtgctcaggaggatggttgtgtagtcatggaggacccctggatccttgccattcccctcagctaatgacggagtgctccttctccagttcggggtgaaaaagttctgaattctgtggaggagaagaaaagtgattcagtgatttcagatagactactgaaaacctttaaagggggaaaaggaaagcatatgtcagttgtttaaaacccaatatctattttttaactgattgtataactctaagatctgatgaagtatattttttattgccattttgtcctttgattatattgggaagttgactaaacttgaaaaatgtttttaaaactgtgaataaatggaagctactttgaaaaaaaaaaaaaaaaaaaaaaaaaaaaaaaaaaaaaaaaaaaa

SEQ ID NO: 1427 - protein, 337 aa, Homo sapiens
MGAAGSSALARFVLLAQSRPGWLGVAALGLTAVALGAVAWRRAWPTRRRRLLQQVGTVAQLWIYPVKSCKGVPVSEAECTAMGLRSGNLRDRFWLVINQEGNMVTARQEPRLVLISLTCDGDTLTLSAAYTKDLLLPIKTPTTNAVHKCRVHGLEIEGRDCGEAAAQWITSFLKSQPYRLVHFEPHKRPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKSYRQCDPSERKLYGKSPLFGQYFVLENPGTIKVGDPVYLLGQ

SEQ ID NO: 1428 - DNA, 4670 bp, Homo sapiens
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaaaaaaaaaaaaaa

SEQ ID NO: 1429 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 1430 - DNA, 1756 bp, Homo sapiens
aggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggggcttgctcaccaccttctccctggagagggcagaagaggtcacacgcagagactgctactacatcttactcacctgccaaggcttggtggccaacacccagaggaacaaattaaggaccgggaattaattcccaggggctccctggtgcccaaaggacaagagcttcca

SEQ ID NO: 1431 - protein, 161 aa, Homo sapiens
MRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGWAEGNLAPHPRSPALQPQQSTAAGLRLSTGPAAAQP

SEQ ID NO: 1432 - DNA, 2445 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaagtaagtccatttaaatttagaactcataaattctatttgtggaaattgtag

SEQ ID NO: 1433 - protein, 814 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKVSPFKFRTHKFYLWKL

SEQ ID NO: 1434 - DNA, 2498 bp, Homo sapiens
tgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaaggttagtgtataa

SEQ ID NO: 1435 - protein, 798 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKVSV

SEQ ID NO: 1436 - DNA, 2566 bp, Homo sapiens
ctcgcctcagtctcctctgtcctctcccaggcaagaggaccggcggaggcacctctctcgagtcttaggctgcggaatctaagactcagcgagaggagcccgggaggagacagaactttccccttttttcccatcccttcttcttgctcagagaggcaagcaaggcgcggagctttagaaagttcttaagtggtcaggaaggtaggtgcttccctttttctcctcacaaggaggtgaggctgggacctccgggccagcttctcacctcatagggtgtacctttcccggctccagcagccaatgtgcttcggagccgctctctgcagagccagagggcaggccggcttctcggtgtgtgcctaagaggatggatcggaggtcccgggctcagcagtggcgccgagctcgccataattacaacgacctgtgcccgcccataggccgccgggcagccaccgcgctcctctggctctcctgctccatcgcgctcctccgcgcccttgccacctccaacgcccgtgcccagcagcgcgcggctgcccaacagcgccggagcttccttaacgcccaccaccgctccggcgcccaggtattccctgagtcccccgaatcggaatctgaccacgagcacgaggaggcagaccttgagctgtccctccccgagtgcctagagtacgaggaagagttcgactacgagaccgagagcgagaccgagtccgaaatcgagtccgagaccgacttcgagaccgagcctgagaccgcccccaccactgagcccgagaccgagcctgaagacgatcgcggcccggtggtgcccaagcactccaccttcggccagtccctcacccagcgtctgcacgctctcaagttgcgaagccccgacgcctccccaagtcgcgcgccgcccagcactcaggagccccagagccccagggaaggggaggagctcaagcccgaggacaaagatccaagggaccccgaagagtcgaaggagcccaaggaggagaagcagcggcgtcgctgcaagccaaagaagcccacccgccgtgacgcgtccccggagtccccttccaaaaagggacccatccccatccggcgtcactaatggaggacgccgtccagattctccttgttttcatggattcaggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaagtgcaggacatcaaaaacaacctgaaagaggcgattgaaaccattgtggccgccatgagcaacctggtgccccccgtggagctggccaaccccgagaaccagttcagagtggactacatcctgagtgtgatgaacgtgcctgactttgacttccctcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaaaaaaaaa

SEQ ID NO: 1437 - protein, 245 aa, Homo sapiens
MDRRSRAQQWRRARHNYNDLCPPIGRRAATALLWLSCSIALLRALATSNARAQQRAAAQQRRSFLNAHHRSGAQVFPESPESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 1438 - DNA, 2791 bp, Homo sapiens
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctgctccatagcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaaaaaaaaaaaaaaa

SEQ ID NO: 1439 - protein, 482 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHSFTQLPGRRRCLAHRGGGLCALRCGGQMSSLPGSTSCVRMSLTDTWGS

SEQ ID NO: 1440 - DNA, 2451 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacgtgagttttctaatattaacatccatctttccctcccaattttcaaatattaaatgtcacattcacccactttttttgtatttaaaaattatgtcttag

SEQ ID NO: 1441 - protein, 816 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNVSFLILTSIFPSQFSNIKCHIHPLFLYLKIMS

SEQ ID NO: 1442 - DNA, 2619 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaaggtgagtcttttactttttcttgccaattctaaaattgttctttttaaaaaattctatatgatttctactagttatttagattcatagttcttcatttattttatatcatcctaccgtgcgatttt

SEQ ID NO: 1443 - protein, 824 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKVSLLLFLANSKIVLFKKFYMISTSYLDS

SEQ ID NO: 1444 - DNA, 1528 bp, Homo sapiens
cggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactg

SEQ ID NO: 1445 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 1446 - DNA, 2491 bp, Homo sapiens
ccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccgtccaaccttcagctcaatgacctcactccagattccagagcagtgaaaccagcagaccggcagatggctcagaacaacagccggccagagcttctggacccggagcccggcggcctcctcaccagccaaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1447 - protein, 366 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 1448 - DNA, 5001 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 1449 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1450 - DNA, 4605 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 1451 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1452 - DNA, 1709 bp, Homo sapiens
aggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataaaaaaaaaaaaaaa

SEQ ID NO: 1453 - protein, 323 aa, Homo sapiens
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 1454 - DNA, 3294 bp, Homo sapiens
gtgaagagaggcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcaatgaaagccttccacactttctgtgttgtccttctggtgtttgggagtgtctctgaagccaagtttgatgattttgaggatgaggaggacatagtagagtatgatgataatgacttcgctgaatttgaggatgtcatggaagactctgttactgaatctcctcaacgggtcataatcactgaagatgatgaagatgagaccactgtggagttggaagggcaggatgaaaaccaagaaggagattttgaagatgcagatacccaggagggagatactgagagtgaaccatatgatgatgaagaatttgaaggttatgaagacaaaccagatacttcttctagcaaaaataaagacccaataacgattgttgatgttcctgcacacctccagaacagctgggagagttattatctagaaattttgatggtgactggtctgcttgcttatatcatgaattacatcattgggaagaataaaaacagtcgccttgcacaggcctggtttaacactcatagggagcttttggagagcaactttactttagtgggggatgatggaactaacaaagaagccacaagcacaggaaagttgaaccaggagaatgagcacatctataacctgtggtgttctggtcgagtgtgctgtgagggcatgcttatccagctgaggttcctcaagagacaagacttactgaatgtcctggcccggatgatgaggccagtgagtgatcaagtgcaaataaaagtaaccatgaatgatgaagacatggatacctacgtatttgctgttggcacacggaaagccttggtgcgactacagaaagagatgcaggatttgagtgagttttgtagtgataaacctaagtctggagcaaagtatggactgccggactctttggccatcctgtcagagatgggagaagtcacagacggaatgatggatacaaagatggttcactttcttacacactatgctgacaagattgaatctgttcatttttcagaccagttctctggtccaaaaattatgcaagaggaaggtcagcctttaaagctacctgacactaagaggacactgttgtttacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtctcggcgggaggagaaaaaaagagcagagaaggagcgaatcatgaatgaggaagatcctgagaaacagcgcaggctggaggaggctgcattgaggcgtgcaaaaaagaagttggaaaagaagcaaatgaaaatgaaacaaatcaaagtgaaagccatgtaaagccatcccagagatttgagttctgatgccacctgtaagctctgaattcacaggaaacatgaaaaacgccagtccatttctcaaccttaaatttcagacagtcttgggcaactgagaaatccttatttcatcatctactctgtttggggtttggggttttacagagattgaagatacctggaaagggctctgtttcaagaatttttttttccagataatcaaattattttgattattttataaaaggaatgatctatgaaatctgtgtaggttttaaatattttaaaaattataatacaaatcatcagtgcttttagtacttcagtgtttaaagaaataccatgaaatttataggtagataaccagattgttgctttttgtttaaaccaagcagttgaaatggctataaagactgactctaaaccaagattctgcaaataatgattggaattgcacaataaacattgcttgatgttttcttgtatgtctacattaaacttgagaaaaagtaaaaattagaacactgtatgtagtaatgaaatttcagggacccagaacataatgtagtatatgtttttaggtgggagatgctgataacaaaattaataggaagtctgtaggcattaggatactgacatgtacatggaaaattctagggacaggagcatcattttttccttacctgataccacgaaccagtgacaacgtgaatgctgtattttaagtggttgtatgtttattttcttgagtaacaaatgcatgaaaaattaatgcttcacctaggtaagatcattggtctgtgtgaaatcacaaatgttttttccttcttggttgctgcagcctgggtggatgttcatggagaagctctgttctctatattatggctgtgtgccgttgcttctccctctgcttttatcttttccacagttgaggctgggtatgttctttcaaagaaatggccatgaatatgtgtaagtatacttttgaaaatgagctttcctaaactattgagagttctttccacctcttgcggaaccaactcttggaggagaggcccatgtatctgcacgagcacttagcttgttcagatctctgcattttataaatgcttcttaccaagaaagcatttttaggtcattgcttgtaccaggtaatttttgccggggatgggtaagggttgggttttctggtgggagtggggtggtgggtattttttgttgatgctttagtgcaggcctgttctgaggcaataacaagttgctgtgaaaacagcatgtgctgctgcctttgtaactgcatggaaacttttcacatgggtttttctccaagttaatacagaaatatgtaaactgagagatgcaaatgtaatatttttaacagttcatgaagttgttattaaaataactaacataaaacttaattactttaatattatataattatagtagtggccttgttttacaaacctttaaattacattttagaaatcaaagttgatagtcttagttatcttttgagtaagaaaagctttcctaaagtcccatacatttggaccatggcagctaattttgtaacttaagcattcatatgaactacctatggacatctattaaagtgattgacaaaatctcaaaaaaaaaaaaaaaaaaaaaaaaaaa

SEQ ID NO: 1455 - protein, 483 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRRAKKKLEKKQMKMKQIKVKAM

SEQ ID NO: 1456 - DNA, 5254 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagcgtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactctctggtggagcggcggttgggcgagcgctcgctgtcgagctacgtgtcggtgcacgcggagagcggcaaggtgtacgcgctgcagccgctggaccacgaggagctggagctgctacagttccaggtgagcgcgcgcgatgggggcgtgccgcctctgggcagcaacttgacgctgcaggtgttcgtgctggacgagaacgacaacgctcccgcgctgctggcgtctcccgctggcagcgcgggcggtgcagtcagtgagctggtgctgcggtcggtggttgcgggtcacgtggtggctaaggtgcgcgcagtggacgctgactctggatacaacgcgtggctgtcgtatgaattgcagtcggcggcggttggtgcacgcatcccgtttcgcgtggggctgtacacgggcgagatcagtacgacgcgcgctctggatgagactgactcgccacgccagcgcctactggtgctggtgaaggaccatggcgagccgtcgctgacggccacggccactgtgcttgtgtcgcttgtggagggcagccaggcacccaaggcctcgtcgcgggcttcagtgggcgtggcgcccgaggtggccctggtggatgtcaacgtgtacctgatcatcgccatctgcgcggtgtccagcttgctggtgctcacgctgctgctgtacactgcactgaggtgctcggcggcgcccaccgagggcgcatgtgggccggtgaagcccacgctggtgtgctctagcgcggtggggagctggtcttactcgcagcagaggcggcagagggtgtgttctggggagggcctgcccaaggcggacctcatggccttcagccccagccttccaccatgcccaatggtagatgtggacggggaagatcagtctattggaggggaccactctaggaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1457 - protein, 948 aa, Homo sapiens
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1458 - DNA, 1538 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaaccttagtataaatttactttctcaaattcttgccatgagaggttgatgagttaattaaaggagaagattcctaaaatttgagagacaaaataaatggaacacatgagaaccttccaaaaaaaaaaaaaaaaaaa

SEQ ID NO: 1459 - protein, 365 aa, Homo sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 1460 - DNA, 3699 bp, Homo sapiens
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttt

SEQ ID NO: 1461 - protein, 837 aa, Homo sapiens
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 1462 - DNA, 5619 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 1463 - protein, 699 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1464 - DNA, 5748 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 1465 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 1466 - DNA, 4122 bp, Homo sapiens
tttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgctgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaggaaaggaaagaaaggggtggcctgacactggtggcactactaagtgtgtgttttttaaaaaaaaaaatggaaaaaaaaaagcttttaaactggagagacttctgacaacagctttgcctctgtattgtgtaccagaatataaatgatacacctctgaccccagcgttctgaataaaatgctaattttggaaaaaaaaaaaaaaaaa

SEQ ID NO: 1467 - protein, 906 aa, Homo sapiens
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 1468 - skipped

SEQ ID NO: 1469 - protein, 226 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTPTEKLVAMTMGSGAKMKTSASVSDIIVVAKRISPRVDDVVKSMYPPLDPKLLDARTTALLLSVSHLVLVTRNACHLTGGLDWIDQSLSAAEERLEVLREAALASEPDKGLPGPEGFLQEQSAI

SEQ ID NO: 1470 - DNA, 2308 bp, Homo sapiens
cccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtaaaaaaaaaaaaaaaaaaaaaaaaa

SEQ ID NO: 1471 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 1472 - DNA, 6017 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccaaaaaaaaaaa

SEQ ID NO: 1473 - protein, 836 aa, Homo sapiens
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 1474 - DNA, 1706 bp, Homo sapiens
ctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagagcttcgtcttccagcgcgaagagatagcgcagttggcgcggcagtacgctggtgagcgggcagagggcagggaggggagcggccggcctgggagcggagcctagggttccgaaggcgccatccccggacctaggaccggtgccagccctgactccgccgcccctctgcctccgccagggctggaccacgagctggccttctctcgtctgatcgtggagctgcggcggctgcacccaggccacgtgctgcccgacgaggagctgcagtgggtgttcgtgaatgcgggtggctggatgggcgccatgtgccttctgcacgcctcgctgtccgagtatgtgctgctcttcggcaccgccttgggctcccgcggccactcgggggagacggtagtacacgggcctggtgaggcaacagctgtggagtgggggccaaacacatggatggtggagtacggccggggcgtcatcccatccaccctggccttcgcgctggccgacactgtcttcagcacccaggacttcctcaccctcttctatactcttcgctcctatgctcggggcctccggcttgagctcaccacctacctctttggccaggacccttgaccagccaggcctgaaggaagacctgcggatggacaggagcgggcaggcccgcacatatccacttgctggagcccatgtttacagacagggacatacaccatgcagatcctgagttcctgctgtatgagcagggatatccatgcttatgtatccaaacacagagacccatgggaacaaatgagacacatatagatactgagacctgtgtgtacagtaggaccatgcactcacacccatctggagagggagcccccggtataccaagggagccagttgtgttcagacacacacatcacagcttgactcactaactgaggcctttccatagctccacagcttcccacctcctccccaccaaaccggggttctagagttaaggatgggggagggtattatactgcctcagtctgactcctcaacccagcagcaatttgaggggatgagggggaagaggagctgccttttggaggcccccttcacctgcagctatgatgcccttccccttctcccctgtcctcaccatatgccttatccccattctactcccctgctatgcaagtgcccctgtggcttgtccccaaccccctcagcaacaaagctcagctggggaacgagagtaatttgaagaatgcttgaagtcagcgtcttccattccagaaagacccccattcttcctttgggggtatgatgtggaagctggtttcagcccaggacccaccactgaggagaggatctagacaggtgggcctaattccaaggggcccttcctggcctggagaaggccttttacacacacacaacacatacacacacacacacacacacacatatcacagttttcacacagcccctgctgcattctctgtccatctgtctgtttctattaataaagatttgttgatctgttccaaaaaaaaaaaaaaaaaa

SEQ ID NO: 1475 - protein, 67 aa, Homo sapiens
MQWAVGRRWAWAALLLAVAAVLTQVVWLWLGTQSFVFQREEIAQLARQYAGERAEGREGSGRPGSGA

SEQ ID NO: 1476 - DNA, 3252 bp, Homo sapiens
ctactccaacccctgggcgggcgggggtaccgcctgggcaagggccggggcgccgggccgagccacctcttcccctcccccgcttccctgtcgcgctccgctggctggacgcgctggaggagtggagcagcacccggccggccctgggggctgacagtcggcaaagtttggcccgaagaggaagtggtctcaaaccccggcaggtggcgaccaggccagaccaggggcgctcgctgcctgcgggcgggctgtaggcgagggcgcgccccagtgccgagacccggggcttcaggagccggccccgggagagaagagtgcggcggcggacggagaaaacaactccaaagttggcgaaaggcaccgcccctactcccgggctgccgccgcctccccgcccccagccctggcatccagagtacgggtcgagcccgggccatggagcccccctggggaggcggcaccagggagcctgggcgcccggggctccgccgcgaccccatcgggtagaccacagaagctccgggacccttccggcacctctggacagcccaggatgctgttggccaccctcctcctcctcctccttggaggcgctctggcccatccagaccggattatttttccaaatcatgcttgtgaggaccccccagcagtgctcttagaagtgcagggcaccttacagaggcccctggtccgggacagccgcacctcccctgccaactgcacctggctcatcctgggcagcaaggaacagactgtcaccatcaggttccagaagctacacctggcctgtggctcagagcgcttaaccctacgctcccctctccagccactgatctccctgtgtgaggcacctcccagccctctgcagctgcccgggggcaacgtcaccatcacttacagctatgctggggccagagcacccatgggccagggcttcctgctctcctacagccaagattggctgatgtgcctgcaggaagagtttcagtgcctgaaccaccgctgtgtatctgctgtccagcgctgtgatggggttgatgcctgtggcgatggctctgatgaagcaggttgcagctcagaccccttccctggcctgaccccaagacccgtcccctccctgccttgcaatgtcaccttggaggacttctatggggtcttctcctctcctggatatacacacctagcctcagtctcccacccccagtcctgccattggctgctggacccccatgatggccggcggctggccgtgcgcttcacagccctggacttgggctttggagatgcagtgcatgtgtatgacggccctgggccccctgagagctcccgactactgcgtagtctcacccacttcagcaatggcaaggctgtcactgtggagacactgtctggccaggctgttgtgtcctaccacacagttgcttggagcaatggtcgtggcttcaatgccacctaccatgtgcggggctattgcttgccttgggacagaccctgtggcttaggctctggcctgggagctggcgaaggcctaggtgagcgctgctacagtgaggcacagcgctgtgacggctcatgggactgtgctgacggcacagatgaggaggactgcccaggctgcccacctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtgggcctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaa

SEQ ID NO: 1477 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 1478 - DNA, 3410 bp, Homo sapiens
gaattcgaggatccgggtaccatgggcggcggcaggcctagcagcacgggaaccgtcccccgcgcgcatgcgcgcgcccctgaagcgcctgggggacgggtatgggcgggaggtaggggcgcggctccgcgtgccagttgggtgcccgcgcgtcacgtggtgaggaaggaggcggaggtctgagtttcgagggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccagatatccagtcatgttaaagcgattgatacaatttaccagaccacagacttctccggaatccgtaacatcagtttcatggtgaaacgcataagaatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccacatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttgaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatgggcaatgtgcaggttctatctgtgagaaatatggcttagaggagtgtacgtgtgccagttctgatggcaaagatgataaagaattatgccatgtatgctgtatgaagaaaatggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggctcattggtgggcagtattacttatgggaattgctctgatcatgctaatggctggatttattaagatatgcagtgttcatactccaagtagtaatccaaagttgcctcctcctaaaccacttccaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttaccccatggtacccggatcctcgaattc

SEQ ID NO: 1479 - protein, 748 aa, Homo sapiens
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 1480 - DNA, 1533 bp, Homo sapiens
tctgattggtgacgggtgaggcggcccgaaatcgtaggacttccgaaagcagcggcggcgtttgcttcactgcttggaagtgtgagtgcgcgaagatgcgaaaggtggttttgatcaccggggctagcagtggcattggcctggccctctgcaagcggctgctggcggaagatgatgagcttcatctgtgtttggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagctcatctggacatcatctcgcagtgcaaggaaatctaatttcagcctcgaggacttccagcacagcaaaggcaaggaaccctacagctcttccaaatatgccactgaccttttgagtgtggctttgaacaggaacttcaaccagcagggtctctattccaatgtggcctgtccaggtacagcattgaccaatttgacatatggaattctgcctccgtttatatggacgctgttgatgccggcaatattgctacttcgcttttttgcaaatgcattcactttgacaccatataatggaacagaagctctggtatggcttttccaccaaaagcctgaatctctcaatcctctgatcaaatatctgagtgccaccactggctttggaagaaattacattatgacccagaagatggacctagatgaagacactgctgaaaaattttatcaaaagttactggaactggaaaagcacattagggtcactattcaaaaaacagataatcaggccaggctcagtggctcatgcctataattccagcactttgggaggccaaggcagaaggatcacttgagaccaggagttcaagaccagcctgagaaacatagtgagcccttgtctctacaaaaagaaataaaaataatagctgggtgtggtggcatgcgcatgtagtcccagctactcagaaggatgaggtgggaggatctcttgaggctgggaggcagaggttgcagtgagctgagattgtgccactgcactccagcctgggtgacagcgagaccctgtctcaaaatatgtatatatttaatatatatataaaaccagagctgacaatgacactctggaacattgcataccttctgtacattctggggtacatggatttctactgagttggataatatgcatttgtaataaactatgaactatgaaaaaaaaaaaaaaa

SEQ ID NO: 1481 - protein, 341 aa, Homo sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 1482 - DNA, 4191 bp, Homo sapiens
ggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaactttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaacgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagactttagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaactggttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtcaaaaaaaaaaaaaaaaaaaaaa

SEQ ID NO: 1483 - protein, 592 aa, Homo sapiens
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 1484 - DNA, 5260 bp, Homo sapiens
atggtgttttctaggagagggggcctgggagcccgggatctgcttctttggcttctgctcctcgcagcctgggaggtggggagcggccagctccactactcgatcccggaggaagccaaacacggcaccttcgttggccgcgttgctcaggacctgggactggagctggcggagctggtgcctcgcctgttccgggtggcgtccaaaacacacagggaccttctggaggtaaatctgcagaatggcattttgtttgtgaattctcggatcgatcgcgaggagctgtgccagtggagcgcggagtgcagcatccacctggagttgatcgccgacaggccgctgcaggttttccatgtggaggtgaaggtgaaagacattaacgataatccacccgtcttcaggggcagagaacaaataatatttattcctgaatctagactcctgaattcgcgttttccgatagaaggagctgctgatgcagacattggtgctaacgctcttctaacgtacacgctcagcccgagtgattatttctctttggatgtagaggcaagtgatgaactgagtaaatctctttggcttgaattgagaaaatatttggatagagaagaaacaccagaacttcacttattactgactgccactgatgggggcaaaccggagctgcaaggtacagttgagctgctgatcaccgtcctcgacgttaatgataacgccccactgtttgaccaggccgtatacagagtccacttgttagagactacagcaaatggaacattagtgaccacattaaatgcctctgatgctgacgaaggtgtaaatggtgaagtcgtcttttcctttgacagtggtatttctcgtgacattcaagaaaaattcaaagttgattccagctcaggagaaattaggttaattgataaactggattatgaagaaacaaaatcctacgaaattcaagtaaaggcagttgataaaggaagtcctccgatgtcaaatcactgtaaggttttggtgaaagtgctggatgtaaatgataatgctccagaactggcggtcacttcattgtatttgcctatcagagaggacgctccactcagcaccgtcatcgccctcatcaccgtgtctgaccgtgactcaggtgccaacgggcaggtgacttgctccttaatgccccacgtccccttcaagctggtgtccaccttcaagaattactactcgttggtgttggacagcgccctggatcgcgagagcctgtcggtctatgagctggtggtgaccgcgcgggacgggggctcgccttcgctgtgggccacggccagggtgtccgtggaggtggccgacgtgaatgacaacgcgcctgcgttcgcgcagcccgagtacacagtattcgtgaaggagaacaacccgccgggctgccacatcttcacggtgtctgcgcgggacgcggacgcgcaggagaacgcgctggtgtcctattcgctggtggaacggcgggtgggcgagcgcgcgctgtcgaactacgtgtcagtgcacgcggagagcggcaaggtgtacgcactgcagcccctggaccacgaggagctggagctgctgcagttccaggtgagcgcgcgggatgcgggcgtgccgcctctgggcagcaacgtgacgctgcaggtgttcgtgctggacgagaacgacaacgcgccggcgctgctggcgcctcgagtgggtggcactattggtgcagtcagtgagctggtgccgcgattggtgggtgcgggtcatgtggtggcgaaggtgcgcgcagtggacgccgactcgggctacaacgcgtggctgtcctatgaactgcagccggcagcaggcggcgcgcgcatcccgttccgcgtggggctgtacacgggcgagatcagcacgactcgtgtcctggacgaggctgacttgtcgcgctaccgccttctggtgctagtgaaggatcacggtgagccggcgctgacagccacggccactgtgcttgtatctctggtggagagcggccaggcgccaaaggcgtcttcgcgggcgtcggtgggtgtcgcgggcccagaggcggcgctggtggatgtcaacgtgtacctgatcatcgccatctgcgcggtgtccagcctgctggtgctcacactgctgctgtacacggcgctgcggtgctcagtgccgcccactgagggtgcgtatgtgccgggcaagcccactctggtgtgctccagcgcgttggggagctggtcgaactcacagcagaggcggcagagggtgtgctctagcgagggcccacccaagaccgacctcatggccttcagcccaggcctatctccaagtcttaacacgtcagaaagaaatgaacaaccagaagcaaatttggatctttctggtaatccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1485 - protein, 950 aa, Homo sapiens
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1486 - DNA, 5493 bp, Homo sapiens
gggccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgatctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatccaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagtacccatggagggcaagggctcccgtcccaagaacatgaccccataccggtcacctcctccctatgtcccaccttaacccgcaagcgcctgggtggaggcagggtagggcagggccctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggaccgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccaactgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtccagcttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattcccctgattgagggtgggtgggtggacccaggctccctttgcacacagagcagctacttctaagccatatcgactgttttgcagaggatttgtgtgtcctccctcaggaggggaggcctggtaggagggggggagagttctctgtcctactgctctcaagagggcatttccccttgcgccttctcccacagggcccagcccctctcccctgcccaagtccccagggggtactctggagtgagcagtccccctgtgggggagcctgtaaatgcgggctcagtggaccactggtgactgggctcatgcctccaagtcagagtttcccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 1487 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSDLQSVRTASPDPGEVVSSACAADEPVTVLTVILDADLTKMTPKQRIDLLHRMRSFSEVELHNMKLVPVVNNRLFDMSAFMAGPGNPKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTVPMEGKGSRPKNMTPYRSPPPYVPP

SEQ ID NO: 1488 - DNA, 1543 bp, Homo sapiens
ggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccaaaaaaaaaaaaaaaaaaa

SEQ ID NO: 1489 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1490 - DNA, 4111 bp, Homo sapiens
cggcagggttggaaaatgatggaagaggcggaggtggaggcgaccgagtgctgagaggaacctgcggaatcggccgagatggggtctggcgcgcgctttccctcggggacccttcgtgtccggtggttgctgttgcttggcctggtgggcccagtcctcggtgcggcgcggccaggctttcaacagacctcacatctttcttcttatgaaattataactccttggagattaactagagaaagaagagaagcccctaggccctattcaaaacaagtatcttatgttattcaggctgaaggaaaagagcatattattcacttggaaaggaacaaagaccttttgcctgaagattttgtggtttatacttacaacaaggaagggactttaatcactgaccatcccaatatacagaatcattgtcattatcggggctatgtggagggagttcataattcatccattgctcttagcgactgttttggactcagaggattgctgcatttagagaatgcgagttatgggattgaacccctgcagaacagctctcattttgagcacatcatttatcgaatggatgatgtctacaaagagcctctgaaatgtggagtttccaacaaggatatagagaaagaaactgcaaaggatgaagaggaagagcctcccagcatgactcagctacttcgaagaagaagagctgtcttgccacagacccggtatgtggagctgttcattgtcgtagacaaggaaaggtatgacatgatgggaagaaatcagactgctgtgagagaagagatgattctcctggcaaactacttggatagtatgtatattatgttaaatattcgaattgtgctagttggactggagatttggaccaatggaaacctgatcaacatagttgggggtgctggtgatgtgctggggaacttcgtgcagtggcgggaaaagtttcttatcacacgtcggagacatgacagtgcacagctagttctaaagaaaggttttggtggaactgcaggaatggcatttgtgggaacagtgtgttcaaggagccacgcaggcgggattaatgtgtttggacaaatcactgtggagacatttgcttccattgttgctcatgaattgggtcataatcttggaatgaatcacgatgatgggagagattgttcctgtggagcaaagagctgcatcatgaattcaggagcatcgggttccagaaactttagcagttgcagtgcagaggactttgagaagttaactttaaataaaggaggaaactgccttcttaatattccaaagcctgatgaagcctatagtgctccctcctgtggtaataagttggtggacgctggggaagagtgtgactgtggtactccaaaggaatgtgaattggacccttgctgcgaaggaagtacctgtaagcttaaatcatttgctgagtgtgcatatggtgactgttgtaaagactgtcggttccttccaggaggtactttatgccgaggaaaaaccagtgagtgtgatgttccagagtactgcaatggttcttctcagttctgtcagccagatgtttttattcagaatggatatccttgccagaataacaaagcctattgctacaacggcatgtgccagtattatgatgctcaatgtcaagtcatctttggctcaaaagccaaggctgcccccaaagattgtttcattgaagtgaattctaaaggtgacagatttggcaattgtggtttctctggcaatgaatacaagaagtgtgccactgggaatgctttgtgtggaaagcttcagtgtgagaatgtacaagagatacctgtatttggaattgtgcctgctattattcaaacgcctagtcgaggcaccaaatgttggggtgtggatttccagctaggatcagatgttccagatcctgggatggttaacgaaggcacaaaatgtggtgctggaaagatctgtagaaacttccagtgtgtagatgcttctgttctgaattatgactgtgatgttcagaaaaagtgtcatggacatggggtatgtaatagcaataagaattgtcactgtgaaaatggctgggctcccccaaattgtgagactaaaggatacggaggaagtgtggacagtggacctacatacaatgaaatgaatactgcattgagggacggacttctggtcttcttcttcctaattgttccccttattgtctgtgctatttttatcttcatcaagagggatcaactgtggagaagctacttcagaaagaagagatcacaaacatatgagtcagatggcaaaaatcaagcaaacccttctagacagccggggagtgttcctcgacatgtttctccagtgacacctcccagagaagttcctatatatgcaaacagatttgcagtaccaacctatgcagccaagcaacctcagcagttcccatcaaggccacctccaccacaaccgaaagtatcatctcagggaaacttaattcctgcccgtcctgctcctgcacctcctttatatagttccctcacttgatttttttaaccttctttttgcaaatgtcttcagggaactgagctaatactttttttttttcttgatgttttcttgaaaagcctttctgttgcaactatgaatgaaaacaaaacaccacaaaacagacttcactaacacagaaaaacagaaactgagtgtgagagttgtgaaatacaaggaaatgcagtaaagccagggaatttacaataacatttccgtttccatcattgaataagtcttattcagtcatcggtgaggttaatgcactaatcatggattttttgaacatgttattgcagtgattctcaaattaactgtattggtgtaagatttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttattttaacaatcaagtatacatattaaaaattgtgagcaatctcaaaaaaaaaaaaaaa

SEQ ID NO: 1491 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1492 - DNA, 5260 bp, Homo sapiens
atgctgtcttcctggcaaggaggcccaagaccgcggcaactactgctctggcttctgatcctcgcagcctgggagacgggtagtggccagctccactactccgtccccgaggaagcaaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgaggagctgtgtgggcggagcgcggagtgcagcatccacctggaggtgatcgtggacaggcctctgcaggttttccatgtggaggtgaaggtgagggacattaacgacaacccgcccatattccctgaaagcaagaaacgaataatcattgcagaatctagacctccggaaactcgatttccactagatggcgcatccgatgcagatattggagtaaactcggcattgacctaccgactggatcccaacgattatttcactttggacgcacaaaacagtcttgagcaaatgtcttcattatcacttgtactgaggaaaacactggacagagaggaaattcaggaacatagtttattactgacagccagtgatggaggtaaacccgagctgactggcacagttcagctgctcatcacgattctggacgtgaatgacaacgccccggaattttaccaatccgtttataaagtgacggtgttagagaacgccttcaatggaacattagtgatcaagctaaatgccacagatcctgatgatggtacaaatggagatatagtttactcatttagaaggcctgtatggcctgcagtggtatatgcatttaccataaatccgaacaatggagaaattaggacaaaaggcaaactagatttcgaagaaaagaaattatatgaaatatccgtggaggcagttgacaaaggaaatattccaatggcgggtcattgtacccttttggtggaagtactagatgtaaatgataacgccccagaggttaccatcacttctttgtcactccccatcagagaagacactcagcctagcgccattattgccctaatcagtgtgtccgatcgtgactctggctcaaatggacaggtcacctgcaccttgacgccgcatgtccccttcaagctggtgtccacctacaagaactactactcattagtgctggacagcgccctggaccgcgagagcgtatcagcctatgaactggtggtgaccgcgcgggacgggggctcgccttcgctgtgggccacggccagcgtgtcggtgggggtggccgacgtgaacgacaacgcgccggcgttcgcgcagcccgagtacacggtgttcgtgaaggaaaacaatccgccgggctgccacatcttcacggtgtctgctcaggacgcggacgcacaggagaacgcgctggtctcctactcgctggtggagcggcgggtgggcgagcgtgcgctgtcgagctacgtgtcggtgcacgcggagagcggcaaggtgtacgcgctgcagccgttggaccacgaggagctggagctgttgcagttccaggtgagcgcgcgcgactctggcgtgccgcctctgggcagcaacgtgacgctgcaggtgttcgtgctggacgagaacgacaacgctccggcgctgctgacgcccggggctggcagcgcgggaggcacagtgagcgagctgatgccgcggtcggtgggtgcaggccacgtggtggcgaaggtgcgcgcggtggacgccgattcgggctacaatgcgtggctttcgtatgaattgcagctggcggcggtcggcgcgcgcatcccgttccgcgtggggctgtacactggcgagatcagcacgacgcgccctctggacgaggtggacgcgccgcaccaccgccttctggtgctggtgaaggaccacggtgagcccgcgctgacggccacggcaacggtgctgttgtcgctggtggagagcggccaagcgccacaggcttcgtcgagggcgtcggcaggcgctgtgggtccagaagcggcgctggtggatgtcaatgtttacttgatcattgccatctgcgcggtgtccagcctgttggtgctcacgttgctgctgtatactgcgctgcggtgctcggcaccgcccaccgagggcgcgtgcgcgccgggcaagcccactctagtgtgctccagcgcggcagggagttggtcgtactcgcagcagaggcggccgagggtgtgctctggggagggcccgcataagacggacctcatggccttcagtcccagccttcctccttgtctgggttctgcagagggaacaggccagagggaggaggactcagaatgcttgaaagagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1493 - protein, 950 aa, Homo sapiens
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1494 - DNA, 5260 bp, Homo sapiens
atggattatcactggcgaggagagctgggatcctggcgactactactcttgcttctgctcctcgcagcctggaaggtggggagcggccagctccactactccgtccccgaggaggccaaacacggcaccttcgtgggccggatcgcgcaggacctggggctggagctggcggagctggtgccgcgcctgttccgggtggcgtccaaaagacaccgggaccttctggaggtaagtctgcagaatggcattttgtttgtgaattctcggatcgaccgcgaggagctgtgcgggcggagcgcggagtgcagcatccacctggaggtgatcgtggacaggccgctgcaggttttccatgtggacgtggaggtgaaggatgttaatgacaacccgccagtgttccgggtaaaagaccaaaagctgtttgtttcagaatccagaatgccagactctcggtttccgctagagggcgcgtccgatgcagatgttggagctaactccgtgttaacctacaggcttagctctcatgattacttcatgctagatgtgaattcaaagaacgatgagaataaactggttgagctcgtattaagaaaatccttggacagagaggacgctcctgcgcaccacttattcctgacagccacagatgggggcaaacctgagctcacaggcactgttcagctgctggtcacagtgctggatgtgaatgataatgctcccactttcgaacagtctgaatacgaagtaagaatattcgaaaacgcagacaacggaacaacagttatcaaactgaatgcttctgatccggatgaaggagccaatggggcaatttcatattcttttaatagccttgttgaaactatggttattgaccactttagcatagatcgaaatacgggagaaatagtgattcggggtaatttggattttgaacaagaaaacttatacaaaatcctcattgacgccacggacaaaggccatcctcccatggcgggtcattgcaccgttttagtgagaattttggataaaaatgataacgtccctgagatagcactgacttccttatccttgcctgtacgtgaagacgctcaatttggtactgtcatcgccctaattagcgtgaacgacctcgattcaggtgccaacgggcaggtgacctgctccctgatgccccatgtccccttcaagctggtgtccaccttcaagaattactactcgttggtgctggacagcgccctggaccgcgagagagtgtcggcctatgagttggtggtaaccgcgcgggacgggggctcgccttcgctgtgggccaccgccagcttgtctgtggaggtggccgacgtgaacgacaatgctccggcgttcgcgcagcccgagtacacggtgttcgtgaaggagaacaacccgccgggctgccacatcttcacggtgtctgcgcgagacgcggacgcgcaggagaacgcgctggtgtcctactcgcttgtggagcggcgggtgggcgagcgctcgctgtcgagctacatttcggtgcacacggagagcggcaaggtgtacgcgctgcagccgctggaccacgaggagctagagctgctgcagttccaggtgagcgcgcgcgacgcgggcgtgccgcctctgggcagcaacgtgacgctgcaggtgttcgtgctggacgagaatgacaacgcgccggcactgctggagcctcgggtgggtggcactggtggcgcagcgagcaagctggtgccgcggtctgtgggcgcgggccacgtggtagcgaaggtgcgcgcagtggacgccgactcgggctacaacgcgtggctttcgtatgagctgcagccagctgcaagcagccctcgcatcccgttccgcgtggggctgtacacgggcgagatcagcaccactcgtgtcctggacgaagcggactctccgcgccaccgtctgctggtcctggtgaaggatcatggtgaacctgcgctgaccgccacggccacggttctggtgtcgctggtggagagcggccaggctccaaaagcgtcatcgaggcagtcggctggcgttttgggtccggaagcggcgctggtggatgtcaacgtgtacctgatcatcgccatctgcgcggtatccagcctgctggtgctcacgctgctgctgtacactgcgctgcggtgctcagcactgcccactgagggcgggtgccgggcgggcaagcccactctggtgtgctccagtgcggtggggagctggtcatactcgcaacaacagccgcagagggtgtgctctggtgaggggccaccgaagacggacctcatggccttcagcccctgccttcctcctgatctgggatcagttgatgtaggcgaagagcaagatttaaatgttgatcatggcctcaaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1495 - protein, 950 aa, Homo sapiens
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1496 - DNA, 5360 bp, Homo sapiens
agaagcggaggaataagagaagcagcaggactttaacagagactagaatatttaaatttttgcaaaacatgctcttctaatttgatcaaaacattgaggattggtaatggcgtcttctatcagaaggggccgaggggcctggacacggctgctctcgcttctgctcctcgcagcctgggaggtggggagcggccagctccgctactccgtccccgaggaggccaaacacggcaccttcgtgggccgcatcgcgcaggacctggggctggagctggaggagctggtgccgcgcctgttccgggtggcgtccaaaagacacggggaccttctggaggtaaatctgcagaatggcattttgtttgtgaattctcggatcgaccgggaggagctgtgcgggcggagcgcggaatgtagcatccacgtggaggtgatcgtggacaggccgctgcaggttttccatgtggaagtggaggtgaaggacattaacgacaacccgccaatatttccaatgacagtaaagactatccggtttcccgaatcaaggctgcttgattctcggtttcctctagagggagcatctgatgcagatataggagtaaatgctcttctctcctacaagctcagctccagtgagtttttcttcctagatatacaggcaaatgatgaactaagcgaatctttgtctctcgtgctggggaaatcgctggacagagaggaaactgctgaggttaatttgttactggtggctactgatgggggcaaacctgagctcacgggcaccgttcaaatacttattaaggtattagatgtaaatgacaatgaaccaacttttgcccaatcagtttacaaagtaaaattgttagagaatacggcaaatgggaccttagtggttaagttaaacgcttctgatgcagatgaaggaccgaacagcgagattgtgtattcactcggtagtgatgtgtcctccactatacagactaagtttaccatagatcccatctcaggggaaatcagaactaagggaaaattagattatgaagaagcaaagtcctacgagattcaggtcactgcaactgacaaaggaaccccttcaatgtcaggacattgtaaaatttcattaaaacttgtggacatcaatgataacacaccagaagtctcaataacgtctctctcacttcccatctcagagaacgcttccctgggcactgtcattgctctcatcacggtgtcggatcgcgactctggtacgaatggacatgtcacctgctccctgacgccccacgtccctttcaagctggtgtccaccttcaagaattactactcgttggtgctggacagcgccctggaccgcgagagcgtgtcagcctatgagctggtggtgaccgcacgggacgggggctcgccttcactgtgggccaccaccagcgtgtccatcgaggtggccgacgtgaacgacaacgcgccggcgttcgcacagcctgagtacacagtattcgtgaaggagaacaacccgccgggctgccacatcttcacggtgtcagcgtgggatgcggacgcgcaggagaacgcgctggtgtcctactcgctggtggagcggcgggtgggcgagcgcgcgttgtcgagctacgtttcggtgcacgcggagagcggcaaggtgtacgcgctgcagccgctggaccacgaggaagtggagctgctgcagttccaggtgagcgcgcgggatgcgggcgtgccgcctctgggcagcaacgtgacgctgcaggtgttcgtgctggacgagaacgacaacgcgccggcactgttggcgcctagggctggcaccgctgctggcgcagtgagtgagctggtgccgtggtcggtgggtgcagggcacgtggtggcgaaggtgcgcgcagtggacgctgactcaggctacaacgcgtggctttcgtacgagcttcagctgggtactggcagcgctcgcatcccgttccgcgtggggctatacacgggtgagatcagcacgacacgtgccctagacgaggctgactcccctcgacaccgcctactcgtgctggtgaaggaccacggcgaaccagcgttgacagccacggccaccgtgttagtgtcgttggtggaaagtggccaggcacccaaggcctcgtcgcgggcgtgggtgggcgccgcgggctcagaggctacgctggtggatgtcaacgtgtacctgatcatcgccatctgcgcggtatccagcctgttggtgctcacggtgctgctgtacactgcgctgcggtgctcggtgccacccaccgagggtgcgcgcgcgccaggaaagcccacgctggtgtgctccagcgccgtggggagctggtcttactcgcagcagaggcggcagagggtgtgctctggggaggacccccccaagacggacctcatggccttcagccctagcttatctcaaggtccagactccgcagaagagaaacagctctcagaatcagaatacgtaggaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1497 - protein, 948 aa, Homo sapiens
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1498 - DNA, 5360 bp, Homo sapiens
tgactgtgatgctggaaaaaatttactaaatatgtacttacagaaaagggtgactgctcataaaatacctcaggcaagcgatcccttaaaactgattgtcccaactcagaggccctcattttctgcaatggtgattatcggaccaagaggcccgggatcccagcgtctgctgctctcgcttctgctccttgcagcctgggaggtggggagcggccagctccactactccgtctacgaggaggccaaacacggcaccttcgtgggccgcatcgctcaggacctggggctggagctggcggagctggtgccgcgcctgttccgggtggcgtccaaaagacacggggaccttctggaggtaaatctgcagaatggcattttgtttgtgaattctcggatcgaccgcgagaagctgtgcgggcggagcgcggagtgcagtatccacctggaggtgatcgtggacaggccgctgcaggttttccatgtggacgtggaggtgaaggacattaacgacaacccgccggtgttcagagaaagggaacaaaaggtacctgtttctgaatctgcgcctctggactctcattttcctctagagggcgcttctgatgcggatatcggcgtaaactctcttttgacctatgcgttaagtctaaatgagaattttgagcttaaaataaaaacaaaaaaagataaaagtatattgcctgaattagttcttcggaagttattggacagagagcaaacgccaaaactcaatttattgctgatggtaatcgatggcggtaaaccagaactaacagggtctgtccagattcaaataaccgtcctggatgtgaatgacaatggtccggcgtttgataagcccagctataaagtagtgttgtctgaaaatgtccaaaacgacacaagagtgatccaactaaatgcttccgatccagacgaaggacttaatggagaaatttcctatgggatcaaaatgattttgccagtgagtgagaaatgtatgttttcaataaatccagacacaggtgaaattagaatttatggtgaactggattttgaagagaataatgcctatgaaattcaggttaacgccattgataaagggattccttccatggcaggtcacagcatggtcctggtggaagttctggacgtgaatgacaatgtccctgaagtaatggttacttcactgtcgctccctgtgcaagaggatgctcaggtgggtaccgtcattgccctgattagcgtgtcggatcgtgactctggagccaatggacaggtcatctgctcactgacacctcatgttcccttcaagctggtgtccacctacaagaattactactcgttggtgctggacagcgccctggaccgcgagagcgtgtcggcctatgagctggtggtgactgcgcgggatgggggctcgccttcgctgtgggccacggctagagtgtccgtggaggtggccgacgtgaacgacaatgcgcctgcgttcgcgcagcccgagtacacagtgttcgtgaaggagaacaacccgccgggctgccacatcttcacggtgtcggcatgggacgcggacgcgcagaagaacgcgctggtgtcctactcgctggtggagcggcgggtgggcgagcacgcactgtcgagctacgtgtcggtgcacgcggagagcggcaaggtgtacgcgctgcagccgctagaccacgaggagctggagctgctgcagttccaggtgagcgcgcgcgacgccggcgtgccgcctctgggcagcaacgtgacgctgcaggtgttcgtgctggacgagaacgacaacgcgccggcactgctggcgactccggctggcagcgcaggaggcgcagttagcgagttggtaccgcggtcggtgggtgcgggccacgtggtggcgaaagtgcgcgcggtggacgctgactccggctataacgcttggctgtcctacgagttgcaaccggcggcggtcggcgcgcacatcccgttccacgtggggctgtacactggcgagatcagcacgacacgcatcctggatgaggcggacgctccgcgccaccgcctgctggtgctggtgaaggaccacggtgagcccgcgctgacgtccacggccacggtgctggtgtcgctggtggagaacggccaggccccaaagacgtcgtcgcgggcctcagtgggcgctgtggatcccgaagcggctctggtggatattaacgtgtacctcatcatcgccatctgtgcggtgtccagcctgctggtgctcacgctgctgctgtacactgcgctgcgttgctcagcgccgcccaccgtgagccggtgcgcgccgggcaagcccacgctggtgtgctccagcgccgtggggagttggtcttactcgcagcagaggaggcagagggtgtgctctgcagagagcccgcccaagacggacctcatggccttcagcccaagccttcagctgtctcgagaagattgtttaaatcctcccagtgaaccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1499 - protein, 941 aa, Homo sapiens
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1500 - DNA, 5352 bp, Homo sapiens
tgaaatatggaggatgcagctgcacttgactgaccgattaaaagatttcccttgactttgagaaacgatatttaatcagaacaaaatactgtgcactaaagatggagttttcctggggaagcggccaggaatcccggcgtctgctgctcttacttcttctcctcgcagcctgggaggcagggaacggtcagctccactactcggtctccgaggaggccaaacacggcaccttcgtgggccgcatcgcgcaggacctgggactggagctggcggagctggtgccgcgcctgttccgggtggcgtccaagggccgcggaggccttctggaggtaaatctgcagaatggcattttgtttgtgaattctcggatcgaccgggaggagctgtgccggcggagcgcggagtgcagcatccacctggaggtgatcgtagacaggccgctgcaggttttccatgtggacgtggaggtgagggacattaacgataacccgccggtgttcccagcaacacaaaagaacctgtccatcgcggaatccaggccgcttgactctcggtttccactagagggcgcctcggatgcagatatcggggagaacgccctgctcacttacagactgagcccaaatgaatacttttctctggaaaaaccacctgatgacgagctggtaaaaggtcttgggcttatattacggaaatctttagacagagaagaagctccggagatttttttagtgctcacagccactgatggaggcaaacccgagttgactggcaccgttcagttactcatcacagtactggatgccaatgacaatgccccagcttttgacagaaccatttataaggtgagattactagaaaatgttcctaatggaacattggtaattaaacttaacgcctcagatttagacgaaggattgaatggggacattgtttattcattctcaaatgatatttcgccaaatgtgaaatccaagtttcacatagatccaattactggacaaattattgtaaagggatatattgactttgaagaaagcaaatcctatgaaattattgtagagggcattgataagggacagctcccactttctggccattgtagagttattgtggaagtagaagacaacaacgataatgtcccagatttggaattcaagtctttatcacttccaattagagaggacgctccactgggtacagtcatcgccctgatcagcgtgtccgacaaagacatgggtgtcaatgggctggtcacctgctccttgacgtcccacgtccccttcaagctggtgtccaccttcaagaattactactcgttggtgctggacagtgccctggaccgcgagagcgtgtcagcctatgagctggtggtgaccgcgcgagacgggggctcgccttcgctgtgggccacggccagtgtttctgtggaggtggctgatgtgaacgacaacgctccggcgttcgcgcagcccgagtacacagtgttcgtgaaggagaacaacccgccgggctgccacatcttcactgtgtctgcgtgggacgcggacgcgcaggagaacgcgctggtgtcctactcgctggtagagcggcgggtaggggagcgcgcgctgtcgagctacgtttcggtgcatgcggagagcggcaaggtgtacgcgctgcagccgctggaccacgaggagctagagctgctgcagtttcaggtgaccgctcgcgatgccggcgtgccacctctgggcagcaacgtgacgctgcaggtgttcgtgctggacgaaaacgacaacgcgccagcactgctagcgcctcgggcgggtggcactggtggcgcagtgagcgagctggtgccatggtcggtgggtgtgggccacgtggtggcaaaggtgcgcgcggtggatgctgactcgggctacaacgcgtggctttcgtacgagctgcagccggggactggtggcgcgcgcatcccgttccgcgtggggctgtacactggcgagatcagcacaacgcgtgccctggacgaaacggacgctccgcgccaccgcctactggtactggtgaaggaccacggcgagcccgcgctgacggccacggccactgtgctggtgtcacttgtggagagtggacaggcgccaaaggcctcctcacgggcgttggtgggcgctgtgggtcccgatgctgcgctggtggatgtcaacgtatacctgatcattgccatctgcgcggtgtccagccttttggtgctcacgctgctgctgtacaccgcgctgcggtgctctgcgctgcccaccgagggcgcgtgcgctccgggcaagcccacgctggtgtgctccagtgcggtggggagctggtcatactcgcagcagaggaggccgagggtgtgctctggtgagggcccacccaagaccgacctcatggccttcagccccagtttacctgactctagggacagagaagatcagctgcagacaactgaggaatcctttgcaaagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1501 - protein, 947 aa, Homo sapiens
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1502 - DNA, 5218 bp, Homo sapiens
atggtatattcccggagaggaagtctgggatcccggctcctgctgctctggcttctccttgcctactggaaggcagggagcggccagctccactactcgatcccggaggaagccaaacacggaaccttcgttggccgcatcgcgcaggacctagggctggagctggcggagctggtgccgcgcctgttccgggtggcgtccaagggccgcggggaccttctggaggtaaatctgcagaatggcattttgtttgtgaattctcggatcgaccgggaggagctgtgccggcggagggcggagtgcagcatccacctggaggtgatcgtggacaggccgctgcaggttttccatgtggaggtggcagtgaaggacatcaatgacaatccgcccaggttctccagacaagaacaaagattattcattttagagtcaagaatgccagattcgcggtttccgctagagggcgcgtcggatttggatattggagcaaatgcacaattgagatacaggttaaatccaaacgaatattttgacttagatgttaaaacaaatgaagaagaaacgaactttttagagctggttttgaggaaatccttagatagagaagaaacacaagaacaccgtttattagtgattgcaactgatggaggaaaacccgaactaacaggtacagttcagttgttgatcaatgtattggatgctaatgataacgccccagaatttgataaatccatttataatgtcagattgttggaaaatgcaccaagtgggacattagttattaaactgaacgcctcagatgcagatgagggcatcaataaggaaatagtgtatttctttagtaatcttgttcttgacgatgtaaagtccaaatttataattaattctaatactggtgaaataaaagttaacggggaactggattatgaagactataactcatatgaaattaatattgatgccatggataaaagtacattcccattatcaggacactgtaaagtagtagtgaaactcctggatgtgaatgataataccccagagatggccataaccacccttttcctgcctgtcaaagaggacgctccactcagcacggtcattgctctgatcagcgtgtctgaccgtgactcaggtgccaacgggcaggtgacctgctccctaatgccccacgttcccttcaagctggtgtccaccttcaagaattactactcgttggtgctggacagcgccctggaccgcgagagcgtgtcggtctatgagctggtggtgaccgcgcgggacgggggctcgccttcgctgtgggccaccgccagcgtgtctgtggaagtggccgacgtgaacgacaacgctccggcgttcgcgcagccccagtataccgtgttcgtgaaggagaacaacccgccaggctgccacatcttcacggtgtctgcacgggacgcggacgcgcaggagaacgccctggtgtcctactcgctggtggagcggcgggtgggcgagcgcccgctgtcgagttacgtttcggtgcacgcggagagcggcaaggtgtacgcgctgcagccgctggaccacgaggaagtggagctgctgcagttccaggtgagcgcgcgcgacgcgggcgtgccgcctctgggcagcaacgtgacgctgcaggtgttcgtgctggacgagaacgacaacgcgccggcgctgctggtgcctcgagtgggtggcaccggcggcgcagtgagcgagctggtgccgaggtcagtgggtgcgggccacgtggtggcgaaggtgcgcgcagtggaccctgattcgggctacaacgcttggctttcgtatgagctgcagccagcgcctggcagtgcgcgcatcccgttccgcgtggggctgtacacaggcgagatcagcacaacacgctctctggatgagaccgaagcaccgcgccaccgccttctggtgctggtgaaggaccatggagagcccccgctgacagccacagccacagtgctggtgtcgctggtggaaagtggccaggcgccgaaggcctcatcgcgggcgtcggcgggcgctgtgggtcccgaggctgccctggtggatgtcaacgtgtacctgatcatcgccatctgtgcggtgtccagcctgctggtgctcacgctgctgctgtacaccgcgctgcggtgctcggcgcagcccaccgaggccgtgtgcacacggggcaagcccactctgttgtgctccagcgcggtggggagctggtcgtactcgcagcagaggagacagagggtgtgctctggggaagctccacccaaaacagacctcatggccttcagtccaagccttcctcagggtcccacctctacagacaacccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 1503 - protein, 936 aa, Homo sapiens
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 1504 - DNA, 2717 bp, Homo sapiens
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaaaaaaaaaaaaaaa

SEQ ID NO: 1505 - protein, 667 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 1506 - DNA, 2729 bp, Homo sapiens
ggtgcgtcccccaacctgatgctagcccctttcctgttacttctcacccacagcaggagccccttgtctttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaaaaaaaaaaaaaaa

SEQ ID NO: 1507 - protein, 667 aa, Homo sapiens; identical to SEQ ID NO: 1505

SEQ ID NO: 1508 - DNA, 3105 bp, Homo sapiens
ccccaggtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaaaaaaaaaaaaaaaaaa

SEQ ID NO: 1509 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1510 - DNA, 2710 bp, Homo sapiens
cgccggcgggactggtctgaagagacgcggggacaaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagaggatgtttggcattgtaaaaatcagcatgccagacctgaactttaatcagtctgcacatcctgtttctaatatctagcaacattatattctttcagacatttattttagtccttcatttccgaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctgaaaaaaaa

SEQ ID NO: 1511 - protein, 610 aa, Homo sapiens
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 1512 - protein, 298 aa, Homo sapiens; identical to SEQ ID NO: 1197

SEQ ID NO: 1513 - protein, 385 aa, Homo sapiens
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1514 - protein, 269 aa, Homo sapiens
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 1515 - protein, 119 aa, Homo sapiens; identical to SEQ ID NO: 669

SEQ ID NO: 1516 - protein, 114 aa, Homo sapiens
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 1517 - protein, 77 aa, Homo sapiens
MNVLLGSVVIFATFVTLCNASCYFIPNEGVPGDSTRMFLHLWVMTKTTAKESSRRRTASISWWRRRTQKRPVLSVNG

SEQ ID NO: 1518 - protein, 832 aa, Homo sapiens
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 1519 - protein, 165 aa, Homo sapiens
MKPLIWTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 1520 - protein, 476 aa, Homo sapiens; identical to SEQ ID NO: 1369

SEQ ID NO: 1521 - protein, 450 aa, Homo sapiens
MILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHRLPSRRQPGLLHLQSCGDLHTFTPAGRPRAERRPRRVEAERPHSLIGVIRETVL

SEQ ID NO: 1522 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 1523 - protein, 1016 aa, Homo sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 1524 - protein, 181 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 1525 - protein, 87 aa, Homo sapiens
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 1526 - protein, 113 aa, Homo sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 1527 - protein, 284 aa, Homo sapiens
MEPGNYATLDGAKDIEGLLGAGGGRNLVAHSPLTSHPAAPTLMPAVNYAPLDLPGSAEPPKQCHPCPGVPQGTSPAPVPYGYFGGGYYSCRVSRSSLKPCAQAATLAAYPAETPTAGEEYPSRPTEFAFYPGYPGTYQPMASYLDVSVVQTLGAPGEPRHDSLLPVDSYQSWALAGGWNSQMCCQGEQNPPGPFWKAAFADSSGQHPPDACAFRRGRKKRIPYSKGQLRELEREYAANKFITKDKRRKISAATSLSERQITIWFQNRRVKEKKVLAKVKNSATP

SEQ ID NO: 1528 - protein, 340 aa, Homo sapiens
MSFPNSSPAANTFLVDSLISACRSDSFYSSSASMYMPPPSADMGTYGMQTCGLLPSLAKREVNHQNMGMNVHPYIPQVDSWTDPNRSCRIEQPVTQQVPTCSFTTNIKEESNCCMYSDKRNKLISAEVPSYQRLVPESCPVENPEVPVPGYFRLSQTYATGKTQEYNNSPEGSSTVMLQLNPRGAAKPQLSAAQLQMEKKMNEPVSGQEPTKVSQVESPEAKGGLPEERSCLAEVSVSSPEVQEKESKEEIKSDTPTSNWLTAKSGRKKRCPYTKHQTLELEKEFLFNMYLTRERRLEISKSVNLTDRQVKIWFQNRRMKLKKMSRENRIRELTANLTFS

SEQ ID NO: 1529 - protein, 388 aa, Homo sapiens; identical to SEQ ID NO: 1353

SEQ ID NO: 1530 - protein, 878 aa, Homo sapiens
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEHFDFHYFSDRMGILDIEVWGKDNKKHEERLGTCKVDISALPLKQANCLELPLDSCLGALLMLVTLTPCAGVSVSDLCVCPLADLSERKQITQRYCLQNPLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 1531 - protein, 142 aa, Homo sapiens
MTVGARLRSKAESSLLRRGPRGRGRTEGDEEAAAILEHLEYADEAEAAAESGTSAADERGPGTRGARRVHFALLPERYEPLEEPAPSEQPRKRYRRKLKKYGKNVGKVIIKGCRYVVIGLQGFAAAYSAPFAVATSVVSFVR

SEQ ID NO: 1532 - protein, 123 aa, Homo sapiens; identical to SEQ ID NO: 659

SEQ ID NO: 1533 - protein, 130 aa, Homo sapiens
MAAENNCGVEPPPCGGPVLGTDPMFYTSRLFFSLQYYCLFLRSRVGVEATVPSYLCLCPASSPHFRALDTLLGPLCAFSVLFPGDVPRALSDVKGSPGKTGAAASCVLQGAPDAFPLGLEVDLVPRARKS

SEQ ID NO: 1534 - protein, 166 aa, Homo sapiens
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 1535 - protein, 56 aa, Homo sapiens
MSMSTSVPIPQPLESHREDHGPAAAECGTHTKTGYHEEGEAAEDGNPGTSEDVILA

SEQ ID NO: 1536 - protein, 50 aa, Homo sapiens
MCLVKGDRRFSDEFTLHEMESGREAGMMEKARGEVLKKKLWKGKFQRGGF

SEQ ID NO: 1537 - protein, 39 aa, Homo sapiens
MPRCEGQMKGMLLERCLLRLLRISGLCPDGRSTIKAQNF

SEQ ID NO: 1538 - protein, 148 aa, Homo sapiens
MKRCETPEILHHQIKCCGDLIVLKTNTVTAQVTVRPKMCILTELERGMVGPVTLHKKIHTTTVLFIVQIHILLIQAITQAKLQMHLMILQMTGLSILALLGKSTTTIVEQKFHNGKNQKSGLKENRDKKKQTRWQSTASQKIGITEER

SEQ ID NO: 1539 - protein, 88 aa, Homo sapiens
MRLKKHRWYKKILKSRDPIIFSVGWRRFQTIPLCYIEDHNGRQRLLKYTPQHVHRGAAFWDPITPQGTGFLAIQSVSGIMPDFRIAAT

SEQ ID NO: 1540 - protein, 355 aa, Homo sapiens
MRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 1541 - protein, 261 aa, Homo sapiens; identical to SEQ ID NO: 1291

SEQ ID NO: 1542 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 1543 - protein, 357 aa, Homo sapiens
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 1544 - protein, 158 aa, Homo sapiens; identical to SEQ ID NO: 687

SEQ ID NO: 1545 - protein, 1061 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDVLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 1546 - protein, 221 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 1547 - protein, 97 aa, Homo sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 1548 - protein, 315 aa, Homo sapiens
MLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 1549 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 1550 - protein, 146 aa, Homo sapiens
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 1551 - protein, 59 aa, Homo sapiens
MQCQLFRTETSKAVSELNYDYICIKAGTGRPQGTPTIGLVLLVRWAIIYETELQSQPIT

SEQ ID NO: 1552 - protein, 261 aa, Homo sapiens; identical to SEQ ID NO: 875

SEQ ID NO: 1553 - protein, 104 aa, Homo sapiens; identical to SEQ ID NO: 753

SEQ ID NO: 1554 - protein, 386 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 1555 - protein, 204 aa, Homo sapiens [sequence omitted]

SEQ ID NO: 1556 - protein, 685 aa, Homo sapiens
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 1557 - protein, 151 aa, Homo sapiens
MAEDLSAATSYTEDDFYCPVCQEVLKTPVRTTACQHVNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 1558 - protein, 462 aa, Homo sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQKQITIPSQEQEHSQKANKISYQSSSTEERRLHYGENGVQKDVSQRSIYSQTEKLVAGKSQIQAPNPKQEPWHGENAKGESGQSTNREQDLLSHEQKGRHQHGSHGGLDIVIIEQEDDSDRHLAQHLNNDRNPLFT

SEQ ID NO: 1559 - protein, 402 aa, Homo sapiens
MKPNIIFVLSLLLILEKQAAVMGQKGGSKGRLPSEFSQFPHGQKGQHYSGQKGKQQTESKGSFSIQYTYHVDANDHDQSRKSQQYDLNALHKTTKSQRHLGGSQQLLHNKQEGRDHDKSKGHFHRVVIHHKGGKAHRGTQNPSQDQGNSPSGKGISSQYSNTEERLWVHGLSKEQTSVSGAQKGRKQGGSQSSYVLQTEELVANKQQRETKNSHQNKGHYQNVVEVREEHSSKVQTSLCPAHQDKLQHGSKDIFSTQDELLVYNKNQHQTKNLNQDQQHGRKANKISYQSSSTEERRLHYGENGVQKDVSQSSIYSQTEEKAQGKSQIQAPNPKQEPWHGENAKGESGQSTNREQDLLSHEQKGRHQHGSHGGLDIVIIEQEDDSDRHLAQHLNNDRNPLFT

SEQ ID NO: 1560 - protein, 170 aa, Homo sapiens
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDKQEFW

SEQ ID NO: 1561 - protein, 220 aa, Homo sapiens; identical to SEQ ID NO: 779

SEQ ID NO: 1562 - protein, 339 aa, Homo sapiens
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 1563 - protein, 95 aa, Homo sapiens
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 1564 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSGMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 1565 - protein, 309 aa, Homo sapiens
MEQLLGIKLGCLFALLALTLGCGLTPICFKWFQIDAARGHHRRVLRLLGCISAGVFLGAGFMHMTAEALEEIESQIQKFMVQNRSASERNSSGDADSAHMEYPYGELIISLGFFLVFFLESLALQCCPGAAGGSTVQDEEWGGAHIFELHSHGHLPSPSKGPLRALVLLLSLSFHSVFEGLAVGLQPTVAATVQLCLAVLAHKGLVVFGVGMRLVHLGTSSRWAVFSILLLALMSPLGLAVGLAVTGGDSEGGRGLAQAVLEGVAAGTFLYVTFLEILPRELASPEAPLAKWSCVAAGFAFMAFIALWA

SEQ ID NO: 1566 - protein, 419 aa, Homo sapiens
MAEDVSSAAPSPRRCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 1567 - protein, 432 aa, Homo sapiens; identical to SEQ ID NO: 1239

SEQ ID NO: 1568 - protein, 323 aa, Homo sapiens; identical to SEQ ID NO: 1453

SEQ ID NO: 1569 - protein, 198 aa, Homo sapiens; identical to SEQ ID NO: 743

SEQ ID NO: 1570 - protein, 492 aa, Homo sapiens; identical to SEQ ID NO: 931

SEQ ID NO: 1571 - protein, 258 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 1572 - protein, 269 aa, Homo sapiens
MARASSGNGSEEAWGALRAPQQQLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 1573 - protein, 510 aa, Homo sapiens
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYERAVHDQQMLALSEQKRIKHWKMASKLILPESLSLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 1574 - DNA, 543 bp, Homo sapiens
tcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaaaaaaaaaaaaaaaaaaaaaaaaa

SEQ ID NO: 1575 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 1576 - DNA, 4354 bp, Homo sapiens
gttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaaaaaaaaaaaaaaaaaaaaaaaaaaaaaaaaaaaaaaaaaaaaaaaaaaaaaaaaaaaaa

SEQ ID NO: 1577 - protein, 411 aa, Homo sapiens
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 1578 - DNA, 2335 bp, Homo sapiens
cggagagagactgtgccagtcccagccgccctaccgccgtgggaacgatggcagatgatcagggctgtattgaggagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaaaccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttgggcactttgttttcaagatggtgttatcttttgaattcttgataaatgactgtttttttctgcctaatagtaactggttaaaaaacaaatgttcatatttattgattaaaaatgtggttgcttaaaaaaaaaaaaaaaaaaa

SEQ ID NO: 1579 - protein, 303 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 1580 - DNA, 1557 bp, Homo sapiens
gcggccgcgggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcttggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgaggcccgtgacacggcgcccacttgccacctaggcgctctggtggcccttgcagaagccctaagtacggttacttatgcgtctacacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaattgcggccctcgtgcc

SEQ ID NO: 1581 - protein, 414 aa, Homo sapiens
AAAGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLLGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1582 - DNA, 1497 bp, Homo sapiens
accaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaag

SEQ ID NO: 1583 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 1584 - DNA, 3028 bp, Homo sapiens
gaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1585 - protein, 789 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 1586 - DNA, 2894 bp, Homo sapiens
atttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgtttatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagtcaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtcttttttttttttttttaatgtatcttaaaggacataaaatttaaaaacttaaatattgtaatatgacagataacctaataattgtatctacattaaaatgacaaacatgatactgctgcttgtcaaataaaaaaaaaaaaa

SEQ ID NO: 1587 - DNA, 1062 bp, Homo sapiens
gcacgagcggcacgagtagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgtaaaaaaaaaaaaaaaaaaaaaaactcgagggggggccc

SEQ ID NO: 1588 - protein, 221 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRMITPYAHCPDLKILGNCSM

SEQ ID NO: 1589 - DNA, 4160 bp, Homo sapiens; identical to SEQ ID NO: 1052

SEQ ID NO: 1590 - protein, 440 aa, Homo sapiens; identical to SEQ ID NO: 1053

SEQ ID NO: 1591 - DNA, 1290 bp, Homo sapiens
agagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcattaaaaaaaaaaaaaaaaaaaaaaaaaaaaa

SEQ ID NO: 1592 - protein, 105 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 1593 - DNA, 469 bp, Homo sapiens
  misc_feature 386, 398, 442, 457, 464: n = A,T,C or G
  misc_feature 386, 398, 442, 457, 464: n = A,T,C or G
ttttttttttttttttaatttagaagaatcagaatttatttcactatgtgaacattaagaatttacctacatagttgaaaatattcacaaaggacttgatcattcacactcatacacagagaaagtctgctgaataaaaaaatgctcctttacccattcgacctcctctcaggggctgcagtgggtttgccaattccactgtggggcttcagtcttcatgaatgttgaatagtttggctacttcattgagatcttcatgctgctcaccgtccttaatgatcttccttgctattgggcattcggttaaagatgttccataggcacaatccccacgaccactttgtccctgaggtagaagatgacacctttgtccgtagtcctccccngggacggggagncctgtgggaactgccggggtgctggggagggattagtaatttgntgagggcctcgggantctgttntacac

SEQ ID NO: 1594 - DNA, 950 bp, Homo sapiens
  misc_feature 883, 884, 885, 886: n = A,T,C or G
  misc_feature 883, 884, 885, 886: n = A,T,C or G
tcctggaaagggcagagcaagtccactgtgggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcggctagccagagttggcacacagaaagcctgccagtgtcactaggccctgagtcctggcagcagattgcaatggatcctgaagaagtgaaaagcttagacaagcacggagctggagaaaagagtgagaaacactccctctaattctgacatggtgccacgtgaagaaaaaaagaggtgccccgaggggcatggaaaaaggcttgctgtggctttctggggcctttgccagcgcgggaaactgcaaaaaggcacttttcctgaaagccccaaattccctttggttccccaaaaattactggccaccctcccctggtgggggaacaagggaaccttgcacaccaaatggggcccccggttgaaaaaaaccaacccccgggaaaaattttctggtttgtgaaaaattttttttaaaaaaaaaaaggggaaaaaccccccacacctggggaccccttttaaaagggggggggagggggggccccccccccccttggggacccccccccccaaaaaaacccttttttttgtttgtgtaaaaggggatatataaccccccccggggggaaaaaaaaaaacccttcttgtgtgggaaaaaaaaaatttccccccccccccccccccccgaaaaaaaaaaaaaaaaacaccgggggggccgcccccctttttttgggggggggggggattnnnntaaaaaaaagggatcgccccccccccccccccgggggagaaaaaaaaataaaaaaccccccccc

SEQ ID NO: 1595 - DNA, 1417 bp, Homo sapiens
ggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcgctggccagccgtgcgtcgcgctcgccagcggctcccccttctcctcggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacacttttttctttttttttcctctctttctttttaaaaaaaggaaaaaaaaaaaa

SEQ ID NO: 1596 - protein, 171 aa, Homo sapiens
MLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 1597 - DNA, 6328 bp, Homo sapiens
cccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttactcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcaaaaaaaaaaaaaaaaaaaaaaaaaaaaa

SEQ ID NO: 1598 - protein, 1591 aa, Homo sapiens
MSLLCVRVKRAKFQGSPDKFNTYVTLKVQNVKSTTVAVRGDQPSWEQDFMFEISRLDLGLSVEVWNKGLIWDTMVGTVWIALKTIRQSDEEGPGEWSTLEAETLMKDDEICGTRNPTPHKILLDTRFELPFDIPEEEARYWTYKWEQINALGADNEYSSQEESQRKPLPTAAAQCSFEDPDSAVDDRDSDYRSETSNSFPPPYHTASQPNASVHQFPVPVRSPQQLLLQGSSRDSCNDSMQSYDLDYPERRAISPTSSSRYGSSCNVSQGSSQLSELDQYHEQDDDHRETDSIHSCHSSHSLSRDGQAGFGEQEKPLEVTGQAEKEAACEPKEMKEDATTHPPPDLVLQKDHFLGPQESFPEENASSPFTQARAHWIRAVTKVRLQLQEIPDDGDPSLPQWLPEGPAGGLYGIDSMPDLRRKKPLPLVSDLSLVQSRKAGITSAMATRTSLKDEELKSHVYKKTLQALIYPISCTTPHNFEVWTATTPTYCYECEGLLWGIARQGMRCSECGVKCHEKCQDLLNADCLQRAAEKSCKHGAEDRTQNIIMAMKDRMKIRERNKPEIFEVIRDVFTVNKAAHVQQMKTVKQSVLDGTSKWSAKITITVVCAQGLQAKDKTGSSDPYVTVQVSKTKKRTKTIFGNLNPVWEEKFHFECHNSSDRIKVRVWDEDDDIKSRVKQRLKRESDDFLGQTIIEVRTLSGEMDVWYNLEKRTDKSAVSGAIRLQISVEIKGEEKVAPYHVQYTCLHENLFHYLTDIQGSGGVRIPEARGDDAWKVYFDETAQEIVDEFAMRYGIESIYQAMTHFACLSSKYMCPGVPAVMSTLLANINAYYAHTTASTNVSASDRFAASNFGKERFVKLLDQLHNSLRIDLSTYRNNFPAGSPERLQDLKSTVDLLTSITFFRMKVQELQSPPRASQVVKDCVKACLNSTYEYIFNNCHDLYSRQYQLKQELPPEEQGPSIRNLDFWPKLITLIVSIIEEDKNSYTPVLNQFPQELNVGKVSAEVMWHLFAQDMKYALEEHEKDHLCKSADYMNLHFKVKWLHNEYVRDLPVLQGQVPEYPAWFEQFVLQWLDENEDVSLEFLRGALERDKKDGFQQTSEHALFSCSVVDVFTQLNQSFEIIRKLECPDPSILAHYMRRFAKTIGKVLMQYADILSKDFPAYCTKEKLPCILMNNVQQLRVQLEKMFEAMGGKELDLEAADSLKELQVKLNTVLDELSMVFGNSFQVRIDECVRQMADILGQVRGTGNASPDARASAAQDADSVLRPLMDFLDGNLTLFATVCEKTVLKRVLKELWRVVMNTMERMIVLPPLTDQTGTQLIFTAAKELSHLSKLKDHMVREETRNLTPKQCAVLDLALDTIKQYFHAGGNGLKKTFLEKSPDLQSLRYALSLYTQTTDTLIKTFVRSQTTQGSGVDDPVGEVSIQVDLFTHPGTGEHKVTVKVVAANDLKWQTAGMFRPFVEVTMVGPHQSDKKRKFTTKSKSNNWAPKYNETFHLLLGNEEGPESYELQICVKDYCFAREDRVLGLAVMPLRDVTAKGSCACWCPLGRKIHMDETGLTILRILSQRSNDEVAREFVKLKSESRSTEEGS

SEQ ID NO: 1599 - DNA, 3464 bp, Homo sapiens
cagcctcccttttgttggcgctgggagagaatgtgggcatgggggtggggaggcgcgaagctccgaggccgggccgcggatactttaaagctcagagctgggagggcccaaaggaaggggcggcgtccacatggttacccttctgctgcgcgggtcaagtagcttcttctggagggcgcaaggcgcggcgggggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtgcgggagggaactctgggcaggctggttttcttggaatgtgtttacgatgttgaatgggacttgaacaggaagctggacgctgcagctggaactagcgtgccaagttatttatgattccatctgatatacataggagagaaactgatagaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttatttctccagtgcgtttttatgaagatctggttgaaaattgtatttctatgtaaactcaacgatatgtttggttttcctgaaaataaatgattttaaataaaaaaaaaaaaaaaa

SEQ ID NO: 1600 - protein, 304 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 1601 - DNA, 1159 bp, Homo sapiens
ggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataaaaaaaaaaaaaaaa

SEQ ID NO: 1602 - protein, 199 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 1603 - DNA, 2868 bp, Homo sapiens
cgcggctaccatggcggcggcatttgaagcctcgggagccttagcggcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgctggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacatcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttactgaacagagagtccctgtattggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaataaaaaaaaaaaaaaaaaa

SEQ ID NO: 1604 - protein, 824 aa, Homo sapiens [sequence omitted]

SEQ ID NO: 1605 - DNA, 158 bp, Homo sapiens
gatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaaa

SEQ ID NO: 1606 - DNA, 599 bp, Homo sapiens; identical to SEQ ID NO: 952

SEQ ID NO: 1607 - protein, 125 aa, Homo sapiens; identical to SEQ ID NO: 953

SEQ ID NO: 1608 - DNA, 2215 bp, Homo sapiens
ttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgcctacaagactatgaaagaggatgaaaaaagatacaatgaaagaatttcagggttagggctgacaccagaacagaaacagaaaaaggccgcgttatctgcttcagaaggagaggaagttcctcaagacaaggcgccaagtcatgttcctttcctgctaattggtggaggcacagctgcttttgctgcagccagatccatccgggctcgggatcctggggccagggtactgattgtatctgaagatcctgagctgccgtacatgcgacctcctctttcaaaagaactgtggttttcagatgacccaaatgtcacaaagacactgcgattcaaacagtggaatggaaaagagagaagcatatatttccagccaccttctttctatgtctctgctcaggacctgcctcatattgagaatggtggtgtggctgtcctcactgggaagaaggtagtacagctggatgtgagagacaacatggtgaaacttaatgatggctctcaaataacctatgaaaagtgcttgattgcaacaggaggtactccaagaagtctgtctgccattgatagggctggagcagaggtgaagagtagaacaacgcttttcagaaagattggagactttagaagcttggagaagatttcacgggaagtcaaatcaattacgattatcggtgggggcttccttggtagcgaactggcctgtgctcttggcagaaaggctcgagccttgggcacagaagtgattcaactcttccccgagaaaggaaatatgggaaagatcctccccgaatacctcagcaactggaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 1609 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1610 - DNA, 943 bp, Homo sapiens
gctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaaaaaaaaaaaaaaaaaaa

SEQ ID NO: 1611 - protein, 181 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 1612 - DNA, 4001 bp, Homo sapiens
ggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctagatcgccgatgtagatttgtacaggagtctccgttggccggaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacctgatattaagggaaactaaagaaaatgttattgtggatcccacagtactatattacactgttttttttgtttgttttgttagttttttttatttaaagcaaacctcaaacattattgggtatcaattaccacctggttgtattgaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataacaaaaaaaaaaaaaaaaaa

SEQ ID NO: 1613 - protein, 78 aa, Homo sapiens
MREENKGMPSGGGSDEGLASAAARGLVEKVRQLLEAGADPNGVNRFGRRAIQVAGAPGPRRQGARERGARPRRIGAGT

SEQ ID NO: 1614 - DNA, 578 bp, Homo sapiens
ttttttttttttttaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttccggaggtttctcagagcctctctggttctttcaatcggggatgtctgagggaccttccgcggcatctatgcgggcatggttactgcctctggtgccccccccagccgcgcgcaggtaccgtgc

SEQ ID NO: 1615 - DNA, 4306 bp, Homo sapiens
cacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaa

SEQ ID NO: 1616 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 1617 - DNA, 986 bp, Homo sapiens
ggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggttgtattgtttttctttccttttctttttttacgcatagctccgtcaagctgcctggatgagcgcccatgcagcaaggcttggaggaagcgtcagtggccctggagatcccagctcgctctccccactgtcagcaacagcacttccttcgtggaggaagtggactcgaatcctggaggaggaaatcacacgggacacggaagtcgtggagaggcagtgaaaatggttacgccagccggcctctggagtcccatggggcggtagctgagttgggaacgcagcggtgatgcagaactggatgaccaggctgggcagtgtctgagactctggatcatctgggcctaggaaggggatagggcaatggcatgccggtcgtgattgtcccacagcggctagtggtcccagggaactcacaacaacggcgtcgagcaaacgcaggcagacacatcaaggtggcagcttaccgtcaaatacagacgggggaaaaccatccacaaagggcacttctacacagtctcgtctagtgcgtctatattccg

SEQ ID NO: 1618 - DNA, 607 bp, Homo sapiens
ttttttttttttttttttaagctataaaaaagtaaaaggggccacaagctttattaaaagtaaatgcaacagtaatatgtacagatggcacatggtgccaattttatttgtaaatatagtactccaactcaagtttacaagttacacctttgccacagccttggctaaatcttgaactagtgcagaattcagctgtggtagagtgctgatcttagcatgcttcgatgtggcatacttgttcttgacagtcatgtgctttgtaagtccttgatttaccatgactacattcttagccaggtgctgcataactggaagaagagattcttcagtatatgacaggtaatgttgtagagttggtgtccattcaccattatccagaattttcagtgctaagcaaaaagctcctgctgcaatttgagaaggaggaaagtgcaccatgtcatagtccaacatagttagttccatcaggtatttggccaaagtatgttgctcgacatcaacctctccaatcttagatgctctccgaaggaagtgcaaaggtagaggccgacccagaccaaagtttaaagctcttagaatcttcatttccatctgtctgatttggtgc

SEQ ID NO: 1619 - DNA, 585 bp, Homo sapiens
ttttttttttttttttttgagaattcattaataattttattttgaattacaatctattatcacttcaaaaagagccacttcagaaaacatccaacggatgttgacttaccagtaaaaatgtaagtcatcaatgtatgatttatactacagaatacataataaattatatttacatgcaatgactagactatcacacacaaggtaaaaaaatacagtattttatgtacattttaaaagatttacatgttcatatacaatttataaagttaaaaattctctgtacaaaatcttacatgtacagagtttatataagccccattcttatggctgtatcaccacacagatttgcttaaaactataatactacaaacactcgggttcttcatattcaatcttggcacccatatagcaatacactattctgaaatgtaaattacaaaggaaataaaatgtaatcatgcagacattttttaatataagaaaatgcgataaaatatactacaccagatcaacatttatcaattccatagatactgagttttcaacttactgcactgttttcatataagtacatgcaaaactagc

SEQ ID NO: 1620 - DNA, 2334 bp, Homo sapiens
cagggccgagttgtctcggcggcgctgccgaggcctccacccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaaaaaaaaaaaaaaaaaa

SEQ ID NO: 1621 - protein, 295 aa, Homo sapiens
MIEVLTTTDSQKLLHQLNALLEQESRCQPKVCGLRLIESAHDNGLRMTARLRDFEVKDLLSLTQFFGFDTETFSLAVNLLDRFLSKMKVQPKHLGCVGLSCFYLAVKSIEEERNVPLATDLIRISQYRFTVSDLMRMEKIVLEKVCWKVKATTAFQFLQLYYSLLQENLPLERRNSINFERLEAQLKACHCRIIFSKAKPSVLALSIIALEIQAQKCVELTEGIECLQKHSKINGRDLTFWQELVSKCLTEYSSNKCSKPNVQKLKWIVSGRTARQLKHSYYRITHLPTIPEMVP

SEQ ID NO: 1622 - DNA, 1627 bp, Homo sapiens; identical to SEQ ID NO: 866

SEQ ID NO: 1623 - protein, 115 aa, Homo sapiens; identical to SEQ ID NO: 867

SEQ ID NO: 1624 - DNA, 1817 bp, Homo sapiens
ccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaaaaaaaaaa

SEQ ID NO: 1625 - protein, 377 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 1626 - DNA, 5736 bp, Homo sapiens
gttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccatagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccatcgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttgaaaaaaaaaaaaaaaaaaaaaaaaaaaaaaaaaaagg

SEQ ID NO: 1627 - protein, 380 aa, Homo sapiens [sequence omitted]

SEQ ID NO: 1628 - DNA, 415 bp, Homo sapiens
tttttttttattttgagacggtcttgctctgtcatccaggctggagtacagtggcgcattcatggcttactgcagcctcaacttcccagactcaagtgttcctcccacctcagcctcctgagcagttgggactacaggcgcatgcaccacacccgtctaattattttatttttttgtaaagacacggtctctctatgttgcctaggctggtgttgaacttctggccttaagtgatcctcccgcctcagcctcctaaagtgctagggttacaggtgtgaatcactacatctggcctaaatttaaaaaagtttttagtctacatccagtgacctatcagggatgcttgttattttatacaagctgctttgttatcatatcagcattctcttcagccagctccaaggcagatagtcac

SEQ ID NO: 1629 - DNA, 672 bp, Homo sapiens
ttttttttttttttttttttttttttttcacagtataacagctctttatttctgtgagttctactaggaaatcatcaaatctgagggttgtctggaggacttcaatacacctccccccatagtgaatcagcttccagggggtccagtccctctccttacttcatccccatcccatgccaaaggaagaccctccctccttggctcacagccttctctaggcttcccagtgcctccaggacagagtgggttatgttttcagctccatccttgctgtgagtgtctggtgcgttgtgcctccagcttctgctcagtgcttcatggacagtgtcagcacatgtcactctccactctctcagtgtggatcccacccctctttcatctctgtatcccacaaataacacagacaccccatcctatctgtgtcctcagagaaattgagtgatatgtctccaggcatggcagtattccccagacacagagatgacaaaattacacatttaagaacactctggttacacttgtgtctgcgatttctttcctagaacctgggactcagactaaggaaaaggtagtagacttgggagcttgattttggcggtcattccttgggcgattctggctgaggcaaattcctaaggagcgattaatcgaacaggaaagctgtcggtggat

SEQ ID NO: 1630 - DNA, 191 bp, Homo sapiens
ttttttttttttttttttttttttttttgcgcttctcttagactttatttctggatctaggggaaagggacaaaaaatgaaaaaccaactggtaaggttgggtcaacgtgccacaagggggcactgtgtacagggagagtctaggtggcattggaccgctgggtctgaaggaggaggggctggtacctgga

SEQ ID NO: 1631 - DNA, 1541 bp, Homo sapiens
ggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagttcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtcaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagctggacttacagaaataaagagctatcatgctgtggttaaaaaaaaaaaaaaaaaaaaaaaaaaaa

SEQ ID NO: 1632 - protein, 261 aa, Homo sapiens; identical to SEQ ID NO: 1291

SEQ ID NO: 1633 - protein, 223 aa, Homo sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 1634 - DNA, 1382 bp, Homo sapiens
cggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaaaaaaaaaaaaaaaaaaaaaaaaaaaaaaaaaaaaaaaaaaaaaaaaaa

SEQ ID NO: 1635 - protein, 380 aa, Homo sapiens; identical to SEQ ID NO: 1245

SEQ ID NO: 1636 - DNA, 465 bp, Homo sapiens
ttttttttttttttttttgacatacaaaaagacaatatttattttactcaagctttcctataagaagttaaacagaaacaatccctggttgaagactaccaaaaatgttaacattgtttcacatatcccttcagggcccagatgaagggaaaaacttaactgaacgaaagaataagaattaccatcctgacactgggtttgcttaggtatgttaggaaaaaatccacataggctagacctaaaacagtaaatgagcctactaatttcccacaggggatgggaaatccactgatacagacacctccaagagctcccaagacctagggatcacaaccaccacaggtattcccataacttccttttccctcccttttccctcagctattttactgctaaaagaagaggatgggaacaaaagatcacttccccactcccagactgcatgactgtcagcatcaatgtttg

SEQ ID NO: 1637 - DNA, 1508 bp, Homo sapiens
cagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaacccacaagagcatcaggctcagctagaagatccacatcctctacaggtcggggaccaaaggctgattcttggagatttaacaccccacaggcaatgggtttatagacattatgtgagtttcctgctatattaacatcatcttagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1638 - protein, 364 aa, Homo sapiens
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 1639 - DNA, 4606 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggcgaacaaggagtcgtcagaaactccagaccagtttatgacagctgatgagacaaggaacctgcagaatgtggacatgaagattggggtgtaacacctacaccattatcttggaaggaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgtttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgcctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgcgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgcatatttattgatggatcaataataatgaggaaagcatgatatgtatattgctgagttgaaagcacttattggaaaatattaaaaggctaacattaaaagactaaaggaaacagaaaaaaaaaaaaaaaaa

SEQ ID NO: 1640 - protein, 361 aa, Homo sapiens [sequence omitted]

SEQ ID NO: 1641 - DNA, 448 bp, Homo sapiens
  misc_feature 421: n = A,T,C or G
  misc_feature 421: n = A,T,C or G
ttttttttttcatttctacaaatatttattttgtcattactgagtgcaaagtatcagggaagtgtagctgtggaataccaatgcttaagagaccacagagttcttgaaacccacgattcttcttcaaatccagatgtgtgtgagccccacctcatcaactctgaaggctgaaggatcagctggaatttctgctgcagggtgtccctgataagctcaaaagcatcagaacggagggagctttctccccttctctcatctcattaaaatgagctttcttgttgtgggggggttggggagggacctttaaaaccaaacaatggtgccctcttatcatcttttcctgtcctcctttctccaagtttccagaggggaaaataaaaccaaacaaacccctcagcattgtgctctcctgacctctaanctcttctcatataaagtgtactgttag

SEQ ID NO: 1642 - DNA, 4243 bp, Homo sapiens
gtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccaaaaaaaaaaaaaaaaaa

SEQ ID NO: 1643 - protein, 1049 aa, Homo sapiens
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 1644 - DNA, 773 bp, Homo sapiens
  misc_feature 726: n = A,T,C or G
  misc_feature 726: n = A,T,C or G
ttttttttttttttttttccgaaatgacaagtaccgtttattgtcgttacacaaatgaacccagcctctggcttgggcaccgtcccacggaccagcagatgagcatggtcagccgacccctttccccacccccgagtcatgtgcagtcatacactccaggcagaaagtcgcagtatcgaataccggacacaggttcccttggcttggtggtgcatctctgatccacagactggcccacctctcggagtggccaacggagtcgctgaaacgttgtcaaataagcaagtaagtgcaggagccctgggctgggggcctctggcctctgcagccgggtgggaggaggatgtccaaggtgtctgcggggtaggcctcggctccacacctccgctgtgaccacagcctcaggtcaagctgtgctggggccatccaccttcctttgccatttagaagatggggcttggagcttggcaacacagaaattgacatcagccttataaaaccttggctgaacctaccgacctccaggagaatttcagccaaaacaaaaaagcaaatacacagagggaccctggaaccagaatccctccccatgggaaagacgaaggcacagagattcgagccaagtttcccaacatgttggtgtttgcagaaaagtccggtcacgtcacacacagcacagaggcaagaagcgaaggcagtggcattcacaggactactttatattanagtttattacatttggaaaatctactgtacagggaaaacccattgga

SEQ ID NO: 1645 - DNA, 4716 bp, Homo sapiens
cggacgcgtgggccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatattttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatatgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcaaaaaaaaaaaaaaaaaaaa

SEQ ID NO: 1646 - DNA, 5015 bp, Homo sapiens
cgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagggggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaataatatgtccttatcattgtataaaagctgttatgtgcaacagtgtggagattccttgtctgatttaataaaatacttaaacactgaaaaaaaaaaaaaaaaaaa

SEQ ID NO: 1647 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 1648 - DNA, 678 bp, Homo sapiens
ttttttttttttttttttttttaaaaagaaagaggctttttattacattgttacaggcaatgcattacgtgagctggtcccgtgtacaatccccaagccacggcaaaacatcaggagaacgcaccgatctcacattgtacacagcgcagaacaggatcaccccgaatgtcaacagaagaccaaaaatcactttacaaaaaaaaataaaaataacacccatttttatatttaaaaaagtgccagcccttgagctgcagacattaaagacgcccaaggacgtgccgccactggaacgaggccgccagccacgtgtggcccgtcctggcctttaaagctgaactgaagcgctccagacactcatctctggagttcctctgtcttaggattttccctctctactgttgtaatgtgtgagcatgtcagcctcaccacgagtgaccttcatgcgtcctacgtgtgacggccagaggctttccctttgtaaggcttaaatctgagtgcagtaaagaatgaagaaaccaaacaccagaaccctaaactcaaatgatattgagccaatttagaggcggacccccacccctcaaagcagcgggattccacccctctgaaaaagcacaaccccaaccctttaaaaaaaggggacccccaccctcttaaaaaaatggacccccaacccct

SEQ ID NO: 1649 - DNA, 3700 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 1650 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 1651 - DNA, 656 bp, Homo sapiens
tttttttttttttttttgggtcacaactgtttattttaagctgaaacttcaatattcattgattacctataataatagttactcataaatgtagttaataattaaatataaaaattattatttttacatttatataaatctctgaaaaataccaagttttgagagatagagcaagaaattgcttagaaaattgcaggaagcctgaagaatctcagcatcagtcaaagcaggtacaacaaaaaacaattttagacattcattttttgctttaagagtgcttaaaataaatgatcacagaatgaataactgatgtatggcaaaaatgagtttaaaactatgtaagctccaaggccccaatgtgtataagaattctttggaaggattttgaaggactgtaaatgttgcaaataaaagtaaaaactagtagttaggcaatgtgttttaaactatagtgtcacctactgttcttctggtgcctaactgtattcttcaacatcttcttttcccttttgattagaaatcctggtctacctcaaaggttttgcattgttttctagggacatcagcaaactggtagaccatatgagaaacagaaataaacagtaatattatctttagaaattaagcattatgtacacagtgagaaatgattgact

SEQ ID NO: 1652 - DNA, 519 bp, Homo sapiens
ttttttttttttgattaaagagaacaggttttattaataaagactgatctcaaaatgctgggattgataaaagaattaaagtttcaacatatcaattttaagaagcaaagtgtttcaacaactgagaggtaagaaaatcttgttatttgcatgtatttttatataatcaatcaggttgcagattctaaaattgctcatatccagcatgatggtgcttgagaccaataaaataagccagcaacactagaataagtactcctgccaaggcagctcccaccgctatgggcacaaggaagttgtcgtcatctgcactgcagtcttgagctagatgtggagaaaggacaattgagaacagaaacagtgacaaactttcaaatctgtgtattttgagtaaaatgacagcacttcctaacacgcatattttggttttttataccaaggtaacaagtcattggcatttcattatcagcaaatgagatgttccacaaaagtgattttccaaataaccaaataatacac

SEQ ID NO: 1653 - DNA, 7633 bp, Homo sapiens; identical to SEQ ID NO: 604

SEQ ID NO: 1654 - protein, 128 aa, Homo sapiens; identical to SEQ ID NO: 599

SEQ ID NO: 1655 - DNA, 1246 bp, Homo sapiens
gaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcaaaaaaaaaaaaaaa

SEQ ID NO: 1656 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 1657 - DNA, 233 bp, Homo sapiens
gtggctcagattatatttctattggacagcgctgctctagaacattatattaagtggttattattgaagtagaccaaagtttataccataaggatatttttccttaaataccatgtttgaagaacaattatttattgatccttgaatctgtaagatcaaataacaagtctctatccatgttaccaaatttaaacttttgaaaataataaactttaaaatgtcaaaaaaaaaaa

SEQ ID NO: 1658 - DNA, 418 bp, Homo sapiens
agagtgcctggaatcagaagaccctgttgaggctgaatttagctgtatgacctcatgcaagccatttaaactctgtgcctcagcgtcctcatttttaaaaggaggtttgatctctatgtttacttccagctctgattctgggattctaatccacaggacttgggtgttagggtggaacctagaactgtgctgtccagtgcagtagccactagccacatgtggctactgagcacttgcaatgtggctagtacaaagtgagatgtgctatcaatgtaagatacataccagattttgaagactagtattaccaaaagaatgtaaaatatcacattaataattttatattaattacatgttcaaatgatattttggatatactgaattaaaacattaaaattaaaaaaaaaaaaaaaaaaaa

SEQ ID NO: 1659 - DNA, 520 bp, Homo sapiens
ttttttttttttttggaggaagtttattaaattaaaaaaaaaaactacaaatgagtaattataaaatataatttcactcttttcattatttaccacaaaaatttaaaaataccaatatacagacgagcacaagtgaactggaaaagagctaaaaattgtataaaagacaaatctaaactcaagaatatatgagaagtgacatacaccatacactctcaagtgagttcagaaagcatgttccgtgctgggcaggttttctttccaggtcagtttttattggcactacacctggaaagctctctaagccaaagttcttatgtgtcaggatcttcctagacctcccttggaaagcatttctcataaaacaactcacaccagacaggctgacttattgtaggcacaaaaatcataaatgcctctcataggccccatggagcttggaaaaaaaagatctgctaatgaaagcattacaaaaacagaaaagtggcacctagtggccacttagcagcttttctttatg

SEQ ID NO: 1660 - DNA, 3249 bp, Homo sapiens; identical to SEQ ID NO: 1060

SEQ ID NO: 1661 - protein, 690 aa, Homo sapiens; identical to SEQ ID NO: 1061

SEQ ID NO: 1662 - DNA, 5566 bp, Homo sapiens
atttttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagaaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagatttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttataagctactcttgtcatttctcgttgaaaaactaaaatctgactaggttagtttactcagctttaattagatagttgagtcatatattttcaacatttttctgtatcgtatttattatgcacaaaaataaagtgtgatctctaat

SEQ ID NO: 1663 - protein, 526 aa, Homo sapiens
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERKSLMTSLTFIHTV

SEQ ID NO: 1664 - DNA, 1665 bp, Homo sapiens
cgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttcaaaaaaaaaaaaaaaaaaaaaaaaaaaaaaaaaaaaaaaaaaaaaaaaaaaaaaaaaaaaaaaaaaaaaaaaaaaaa

SEQ ID NO: 1665 - protein, 400 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 1666 - DNA, 441 bp, Homo sapiens
ttttttttttttttttcatcttttaactgtttattgtataatataaaactacaaaagtaaaactgctcatttccatgtacatttaatctgtccaattgtttaaattacagcccaaacctacatgtgaatacagccatttgggttccgatgtaacgtctgtaatattgcataaaaaaggcacagctctcaggtctgtgggggaaaggttatacctcctttttgacaaaagccctcctcaaaaaccatgccccaaacatgtcactatgtacattttttttcaaaatctcggtcatgcccacatatggcctgcatttcttttccaaaacttgttatccccaaaagaagtccaactttttattggctttgtctgcaatagcatttgatcctggctaattttcaagaaccattcagactcattcttagaaacactgaaaacaattg

SEQ ID NO: 1667 - DNA, 1852 bp, Homo sapiens
agcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaagtcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaaaaaaaaaaaaaaaaaaaaaaaaaaaaaaaaaaaaaaaaaaaaaaaaaaaa

SEQ ID NO: 1668 - protein, 345 aa, Homo sapiens
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 1669 - DNA, 470 bp, Homo sapiens
tttttttttttttattatgtatcatgcttttaatacaaacttaaaaaaatctggaacaatagaaactgtacagatttgatcaatctttttgttttgtttttaaactaaaatctctaaacacaccaatgtcccattccaaaatattgcacaacattctgaatacaaaacccttgattgtattcctcacttcactaaagaaaaaagttcatgaccctgctccccgggctcctctccaggcttgcctcaatgcccccttcccatccctagggagaaaactagagaatctataactcactgcattgagaaaaagacatcattctggactaacagtttccattcttcagaagataatccaccttttgatttgttcctgggaaagagggatagatagaggatggggaaaggggagaaaaggttttatttctcctctttttttttaaaagtttgtttttcctgaaaaaatatgtttc

SEQ ID NO: 1670 - DNA, 1386 bp, Homo sapiens
ttttcttgcctgagtctgaggtgaacagtgaacatattacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataataaaaaaaaaaaaaaaaaa

SEQ ID NO: 1671 - protein, 324 aa, Homo sapiens
MFCGDYVQGTIFPAPNFNPIMDAQMLGGALQGFDCDKDMLINILTQRCNAQRMMIAEAYQSMYGRDLIGDMREQLSDHFKDVMAGLMYPPPLYDAHELWHAMKGVGTDENCLIEILASRTNGEIFQMREAYCLQYSNNLQEDIYSETSGHFRDTLMNLVQGTREEGYTDPAMAAQDAMVLWEACQQKTGEHKTMLQMILCNKSYQQLRLVFQEFQNISGQDMVDAINECYDGYFQELLVAIVLCVRDKPAYFAYRLYSAIHDFGFHNKTVIRILIARSEIDLLTIRKRYKERYGKSLFHDIRNFASGHYKKALLAICAGDAEDY

SEQ ID NO: 1672 - DNA, 992 bp, Homo sapiens
  misc_feature 16, 17, 32, 34, 35, 64: n = A,T,C or G
  misc_feature 16, 17, 32, 34, 35, 64: n = A,T,C or G
aacatytattttsbbnncaagaggctgtgagncnngggggtagaaaaggcatcctgagagagtnctagaccgacccaggtcctgtggcacactatacgggtcaggaggggtggaagacaggcctaagctctaggacggtgaatctcggggctatttgtggatttgttagaaacagacattcttttggccttttcctggcactggtgttgccggcaggtgggcagaagkgagccaccagtcactgttcagtcattgccaccacagatcttcagcagaatcttccggtaatcccctgmagtatctcccgagatgtcgtggtacagcgacttgccgtacatccgcttatactctgatctgatgtccaggaggtcggtctcgctgcgagkcaccatgatgcgaatchgggtccggtcctttgttcctgcccccctcatggccttgttgagcctctccgcaaagaaggctggggtattcttgagwcatttcaccacggccagcatgccctcctccaggtccccggacatctcccggcagatgctcttctcaatgtcccggcctgtcattctctggtactcattgaaaactgctaccaggtgggcccggctccgggagcacagaaccgcattgaacttggactcgtctgttcccaggcggttctccccggccgcatacagctcctgggcatctctctgggcgagtgacatgtccacgtttgtgctttcatcacggtttccctgagagagagagatgaggagccgctggaagtgccctgatgtgtcgcttcgaatggcctcttccaggggtctttttgaattctgctttgtaggctctgttttaattctcggatgtgctcattgctgcgggaagcgaggatctcaatcaggcaggcttcatcagtgccaaccccttgatggcttctttatctataaatgtmaagagactggggtytcatcagagcaagattgtctctcaaagttyctgacagtcagatt

SEQ ID NO: 1673 - DNA, 1456 bp, Homo sapiens
gggacgctctcagctctcggcgcacggcccaggttatcttgtagcatagcaacttcggatttcactctacccggagagtttcccgcttggttgaacacattggcctcaggaagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttaaaaaaaaaaaaaaaaaaa

SEQ ID NO: 1674 - protein, 339 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADRLYDSMKGKGTRDKVLIRIMVSRSEVDMLKIRSEFKRKYGKSLYYYIQQDTKGDYQKALLYLCGGDD

SEQ ID NO: 1675 - DNA, 1529 bp, Homo sapiens
ggcgcgctaagcccgaggtttcttctcttttgcagtcctgcttcaccttcccctgacctgagtagtcgccatggcacaggttctcagaggcactgtgactgacttccctggatttgatgagcgggctgatgcagaaactcttcggaaggctatgaaaggcttgggcacagatgaggagagcatcctgactctgttgacatcccgaagtaatgctcagcgccaggaaatctctgcagcttttaagactctgtttggcagggatcttctggatgacctgaaatcagaactaactggaaaatttgaaaaattaattgtggctctgatgaaaccctctcggctttatgatgcttatgaactgaaacatgccttgaagggagctggaacaaatgaaaaagtactgacagaaattattgcttcaaggacacctgaagaactgagagccatcaaacaagtttatgaagaagaatatggctcaagcctggaagatgacgtggtgggggacacttcagggtactaccagcggatgttggtggttctccttcaggctaacagagaccctgatgctggaattgatgaagctcaagttgaacaagatgctcaggctttatttcaggctggagaacttaaatgggggacagatgaagaaaagtttatcaccatctttggaacacgaagtgtgtctcatttgagaaaggtgtttgacaagtacatgactatatcaggatttcaaattgaggaaaccattgaccgcgagacttctggcaatttagagcaactactccttgctgttgtgaaatctattcgaagtatacctgcctaccttgcagagaccctctattatgctatgaagggagctgggacagatgatcataccctcatcagagtcatggtttccaggagtgagattgatctgtttaacatcaggaaggagtttaggaagaattttgccacctctctttattccatgattaagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaaaaaaaaaaaaaaaaaaaaaaaaaaa

SEQ ID NO: 1676 - protein, 320 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 1677 - DNA, 573 bp, Homo sapiens
tttttttttttgtgtttatgtgtttgtgtatctctttttatttcttccttagaaataaaaagtgtcaagggaatgaatcggaggcatactttaggaagttaatgttagaagggaagccaagatttttttgtccaactgtctcattgtagataagaaaatagagactcagggagggaaaggggctggcctaaggtcagaaacaagtgcatggcagatgcagatttgaacccaggcatccaaattcctggtccagtactctagcgcggcctggatggagatgggtggtgaaatggatgggaagatttgtcagtttgccccagcacatttaccttccttcccaccaccccgcccagcacattcaactggcccctgccaccaaccccctcattcaaagtacagacactactcattttacagacagaggttcaggatgtttttggatctgacatagcccaaaccagggcagaggctgtagcaaggggaggaagctgggaaagcctgagggtcagaggggaggtgaggtggacaggatctatggctacggtttttcagccgctcagccgtgctgggccc

SEQ ID NO: 1678 - DNA, 1408 bp, Homo sapiens
atttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaaaaaaaaaaaaaaaaaaaaaaaaaaaaaaa

SEQ ID NO: 1679 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 1680 - DNA, 673 bp, Homo sapiens
ggggacagcccgccgcgctcgcctctccgccccgcgtccagctcgcccagctcgcccagcgtccgccgcgcctcggccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccagaaaaaaaaaaaaaaaaaaaaaaaaaaaaaa

SEQ ID NO: 1681 - protein, 97 aa, Homo sapiens
MPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 1682 - DNA, 1764 bp, Homo sapiens
acaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttccttaaaaaaaaaaaaaaaaaaa

SEQ ID NO: 1683 - protein, 476 aa, Homo sapiens; identical to SEQ ID NO: 1305

SEQ ID NO: 1684 - DNA, 1206 bp, Homo sapiens
accctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaattgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgttaaaaaaaaaaaaaaa

SEQ ID NO: 1685 - protein, 232 aa, Homo sapiens
PSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 1686 - DNA, 292 bp, Homo sapiens
ttttttttttttgttgaaaatatatttttattataaacaacataaacacttcctaatacactttgcaaatatgcatttcattttctttgcctgagtttttatcaacagggtctctgagcacaatagttcttcccttgatggccgatcatatattcaataagtgccaagcaccctccccaagtatcaataggcactgtgggaagtgctgggggatttttttaaatgcagagaaaaaaaggcatccttccatatctagggggatcacaatctagtagactgctttaaaaaaaaa

SEQ ID NO: 1687 - DNA, 736 bp, Homo sapiens
gcggtgcctcacttgtttccgctgcatccagacttcctcaggcggtggctggaggctgcgcatctggggctttaaacatacaaagggattgccaggacctgcggcggcggcggcggggcgggggctggggcgcgggggccggaccatgagccgctgagccgggcaaaccccaggccaccgagccagcggaccctcggagcgcagccctgcgccgcggagcaggctccaaccaggcggcgaggcggtcacacgcaccgagccagcgacccccgggcgacgcgcggggccagtgagcgctacgatggaggcgctaatggccggggcgcgctcacgggtcccctgagggcgctctgtctcctgggctgcctgctgagccacgccgccgccgcgccgtcgcccatcatcaagttccccggcgatgtcgccccaaaaggacaaagagttggcagtgcaatacctgaacaccttctatggtgccccaaggagagctgcaacctgtttgtgctgaaggacacactaaagaagatgcagaagttctttggactgccccagacaggtgatcttgaccagaataccatcgagacatgcgggaagccacgctgcggcaacccagatgtggccaactacaactttcttccctcgcaagccaagtgggacaagaacagatcacatcacggatcattggctacacacctgatctggaccagagacagcggatgatgcttttgtccgtgct

SEQ ID NO: 1688 - DNA, 17 bp, Homo sapiens
gatctcagaacaacctt

SEQ ID NO: 1689 - DNA, 17 bp, Homo sapiens
gatccagcccagagaca

SEQ ID NO: 1690 - DNA, 17 bp, Homo sapiens
gatcactccttatttgc

SEQ ID NO: 1691 - DNA, 17 bp, Homo sapiens
gatccctctcctctctg

SEQ ID NO: 1692 - DNA, 17 bp, Homo sapiens
gatctgactttttactt

SEQ ID NO: 1693 - DNA, 17 bp, Homo sapiens
gatcgttagcctcatat

SEQ ID NO: 1694 - DNA, 17 bp, Homo sapiens
gatcacaaggaatcctg

SEQ ID NO: 1695 - DNA, 17 bp, Homo sapiens
gatctcatggatgatta

SEQ ID NO: 1696 - DNA, 17 bp, Homo sapiens
gatccagaaataaagtc

SEQ ID NO: 1697 - DNA, 17 bp, Homo sapiens
gatctcacagaagatgt

SEQ ID NO: 1698 - DNA, 17 bp, Homo sapiens
gatccaaaatcaccaag

SEQ ID NO: 1699 - DNA, 17 bp, Homo sapiens
gatcctgggctggaagg

SEQ ID NO: 1700 - DNA, 17 bp, Homo sapiens
gatccagatgcaggact

SEQ ID NO: 1701 - DNA, 17 bp, Homo sapiens
gatctgtgctcatctgt

SEQ ID NO: 1702 - DNA, 17 bp, Homo sapiens
gatcattttatatcaat

SEQ ID NO: 1703 - DNA, 17 bp, Homo sapiens
gatccacactgagagag

SEQ ID NO: 1704 - DNA, 17 bp, Homo sapiens
gatccgtctgtgcacat

SEQ ID NO: 1705 - DNA, 17 bp, Homo sapiens
gatcattgtagggtaac

SEQ ID NO: 1706 - DNA, 17 bp, Homo sapiens
gatcagccctcaaaaaa

SEQ ID NO: 1707 - DNA, 17 bp, Homo sapiens
gatctggattcaggacc

SEQ ID NO: 1708 - DNA, 17 bp, Homo sapiens
gatcaaaaataaaatgt

SEQ ID NO: 1709 - DNA, 17 bp, Homo sapiens
gatccgctctggtcaac

SEQ ID NO: 1710 - DNA, 17 bp, Homo sapiens
gatccctcaagactggt

SEQ ID NO: 1711 - DNA, 17 bp, Homo sapiens
gatccacaaagacgagg

SEQ ID NO: 1712 - DNA, 17 bp, Homo sapiens
gatctctctgcgtttga

SEQ ID NO: 1713 - DNA, 17 bp, Homo sapiens
gatctcaacctcgcttg

SEQ ID NO: 1714 - DNA, 17 bp, Homo sapiens
gatcaagttcccgctgg

SEQ ID NO: 1715 - DNA, 17 bp, Homo sapiens
gatcataatgaggtttg

SEQ ID NO: 1716 - DNA, 17 bp, Homo sapiens
gatcggtgacatcgtaa

SEQ ID NO: 1717 - DNA, 17 bp, Homo sapiens
gatccaccagctgataa

SEQ ID NO: 1718 - DNA, 17 bp, Homo sapiens
gatcaacacactttatt

SEQ ID NO: 1719 - DNA, 17 bp, Homo sapiens
gatcccttccttcctct

SEQ ID NO: 1720 - DNA, 17 bp, Homo sapiens
gatcaggacacagactt

SEQ ID NO: 1721 - DNA, 17 bp, Homo sapiens
gatcctgcaatcttgta

SEQ ID NO: 1722 - DNA, 17 bp, Homo sapiens
gatcctcctatgttgtt

SEQ ID NO: 1723 - DNA, 17 bp, Homo sapiens
gatctgtaccttggcta

SEQ ID NO: 1724 - DNA, 17 bp, Homo sapiens
gatcggggcaagagagg

SEQ ID NO: 1725 - DNA, 17 bp, Homo sapiens
gatcccctcccctcccc

SEQ ID NO: 1726 - DNA, 17 bp, Homo sapiens
gatcctacaaagaagga

SEQ ID NO: 1727 - DNA, 17 bp, Homo sapiens
gatcatttgcagttaag

SEQ ID NO: 1728 - DNA, 17 bp, Homo sapiens
gatctgtctcctgctct

SEQ ID NO: 1729 - DNA, 17 bp, Homo sapiens
gatccttcccaaggtac

SEQ ID NO: 1730 - DNA, 17 bp, Homo sapiens
gatcttgttgaagtcaa

SEQ ID NO: 1731 - DNA, 17 bp, Homo sapiens
gatcgcaccactgtaca

SEQ ID NO: 1732 - DNA, 17 bp, Homo sapiens
gatcattttctgcttta

SEQ ID NO: 1733 - DNA, 17 bp, Homo sapiens
gatccccacacttgtcc

SEQ ID NO: 1734 - DNA, 17 bp, Homo sapiens
gatctggaattgtcata

SEQ ID NO: 1735 - DNA, 17 bp, Homo sapiens
gatcaataagctttaaa

SEQ ID NO: 1736 - DNA, 17 bp, Homo sapiens
gatcaatgtttgtagat

SEQ ID NO: 1737 - DNA, 17 bp, Homo sapiens
gatctacatgtctatca

SEQ ID NO: 1738 - DNA, 17 bp, Homo sapiens
gatctgttttaaatgag

SEQ ID NO: 1739 - DNA, 17 bp, Homo sapiens
gatcaaaaaatgctgca

SEQ ID NO: 1740 - DNA, 17 bp, Homo sapiens
gatcatgtcttcatttt

SEQ ID NO: 1741 - DNA, 17 bp, Homo sapiens
gatccctccacccccat

SEQ ID NO: 1742 - DNA, 17 bp, Homo sapiens
gatcctaagccataaat

SEQ ID NO: 1743 - DNA, 17 bp, Homo sapiens
gatcatcgtcctcatcg

SEQ ID NO: 1744 - DNA, 17 bp, Homo sapiens
gatcatcatttgtcatt

SEQ ID NO: 1745 - DNA, 17 bp, Homo sapiens
gatctaatttgaaaaac

SEQ ID NO: 1746 - DNA, 17 bp, Homo sapiens
gatcttccttgtatcat

SEQ ID NO: 1747 - DNA, 17 bp, Homo sapiens
gatctcccccatgcctg

SEQ ID NO: 1748 - DNA, 17 bp, Homo sapiens
gatcaaatttagtattt

SEQ ID NO: 1749 - DNA, 17 bp, Homo sapiens
gatctgccttataaaca

SEQ ID NO: 1750 - DNA, 17 bp, Homo sapiens
gatcagaaaatgagctc

SEQ ID NO: 1751 - DNA, 17 bp, Homo sapiens
gatcaccgtggaggtta

SEQ ID NO: 1752 - DNA, 17 bp, Homo sapiens
gatccctctgtgcttct

SEQ ID NO: 1753 - DNA, 17 bp, Homo sapiens
gatctcatttttagagc

SEQ ID NO: 1754 - DNA, 17 bp, Homo sapiens
gatcatcacatttcgtg

SEQ ID NO: 1755 - DNA, 17 bp, Homo sapiens
gatcattttctgcttca

SEQ ID NO: 1756 - DNA, 17 bp, Homo sapiens
gatcaatgaaggagaga

SEQ ID NO: 1757 - DNA, 17 bp, Homo sapiens
gatcccaactactcggg

SEQ ID NO: 1758 - DNA, 17 bp, Homo sapiens
gatcagtttttctgtaa

SEQ ID NO: 1759 - DNA, 17 bp, Homo sapiens
gatcaaaattttaaaaa

SEQ ID NO: 1760 - DNA, 17 bp, Homo sapiens
gatcacccttctcttcc

SEQ ID NO: 1761 - DNA, 17 bp, Homo sapiens
gatcctgggtactgaaa

SEQ ID NO: 1762 - DNA, 17 bp, Homo sapiens
gatcgttctaagagtgt

SEQ ID NO: 1763 - DNA, 17 bp, Homo sapiens
gatcatcatcaagggct

SEQ ID NO: 1764 - DNA, 17 bp, Homo sapiens
gatcaaaatgattttca

SEQ ID NO: 1765 - DNA, 17 bp, Homo sapiens
gatctgatttttttccc

SEQ ID NO: 1766 - DNA, 17 bp, Homo sapiens
gatcccatttctcaccc

SEQ ID NO: 1767 - DNA, 17 bp, Homo sapiens
gatcctcccgccttgcc

SEQ ID NO: 1768 - DNA, 17 bp, Homo sapiens
gatctttctttttttgt

SEQ ID NO: 1769 - DNA, 17 bp, Homo sapiens
gatcttaactgtctcct

SEQ ID NO: 1770 - DNA, 17 bp, Homo sapiens
gatcagtttgattctgt

SEQ ID NO: 1771 - DNA, 17 bp, Homo sapiens
gatcatgatgtagaggg

SEQ ID NO: 1772 - DNA, 17 bp, Homo sapiens
gatcgcaccactacagt

SEQ ID NO: 1773 - DNA, 17 bp, Homo sapiens
gatctcaaagtgccttc

SEQ ID NO: 1774 - DNA, 17 bp, Homo sapiens
gatcaatgtcaaacttc

SEQ ID NO: 1775 - DNA, 17 bp, Homo sapiens
gatctcccagagtctaa

SEQ ID NO: 1776 - DNA, 17 bp, Homo sapiens
gatcctgatggctgtgt

SEQ ID NO: 1777 - DNA, 17 bp, Homo sapiens
gatcacttcccgcagtc

SEQ ID NO: 1778 - DNA, 17 bp, Homo sapiens
gatctcaaaggaaccaa

SEQ ID NO: 1779 - DNA, 17 bp, Homo sapiens
gatctgtgccagggtta

SEQ ID NO: 1780 - DNA, 17 bp, Homo sapiens
gatctctttttatttaa

SEQ ID NO: 1781 - DNA, 17 bp, Homo sapiens
gatctccagcaccaatc

SEQ ID NO: 1782 - DNA, 17 bp, Homo sapiens
gatctggcgcttggggg

SEQ ID NO: 1783 - DNA, 17 bp, Homo sapiens
gatcccgacgggggcat

SEQ ID NO: 1784 - DNA, 17 bp, Homo sapiens
gatcccgggccgttatc

SEQ ID NO: 1785 - DNA, 17 bp, Homo sapiens
gatctttctcaaaatat

SEQ ID NO: 1786 - DNA, 17 bp, Homo sapiens
gatcgtgacgcttaata

SEQ ID NO: 1787 - DNA, 17 bp, Homo sapiens
gatcgcataatttttaa

SEQ ID NO: 1788 - DNA, 17 bp, Homo sapiens
gatcccaacactgaagg

SEQ ID NO: 1789 - DNA, 17 bp, Homo sapiens
gatcttaaaaactgcag

SEQ ID NO: 1790 - DNA, 17 bp, Homo sapiens
gatcattttttctatca

SEQ ID NO: 1791 - DNA, 17 bp, Homo sapiens
gatcccattgtgtgtat

SEQ ID NO: 1792 - DNA, 17 bp, Homo sapiens
gatctcaaaggaaaaaa

SEQ ID NO: 1793 - DNA, 17 bp, Homo sapiens
gatcttctgttatattt

SEQ ID NO: 1794 - DNA, 17 bp, Homo sapiens
gatccacaacatacagc

SEQ ID NO: 1795 - DNA, 17 bp, Homo sapiens
gatctgtgcagttgtaa

SEQ ID NO: 1796 - DNA, 17 bp, Homo sapiens
gatctactatgccaaat

SEQ ID NO: 1797 - DNA, 1240 bp, Homo sapiens
gctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaaaaaaaaaaaaa

SEQ ID NO: 1798 - protein, 339 aa, Homo sapiens; identical to SEQ ID NO: 637

SEQ ID NO: 1799 - DNA, 568 bp, Homo sapiens
gcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcagcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcatccaaaaaaaaaaaaaaa

SEQ ID NO: 1800 - protein, 97 aa, Homo sapiens; identical to SEQ ID NO: 1547

SEQ ID NO: 1801 - DNA, 461 bp, Homo sapiens
tttttttttttttttatggagattttgctttatttgaagataattattttaaggaagtctaaacagacaagcgtctgctgggaaaaagctagtctacctgcttatataaagagctggcacttacaaaacccattaactttctcaaaataccaccctttaaacattgggaaatgtatggttaagagaacaaaaataacagcaaataaggagtgatcagcccggtaagagaagaaccaggatagtgcagtattatgatgaaaaaaaaaaaaaaaaagtcactgcaaccagtacttatgtttattactgtacctaataaacagcccagcgtggtgattcctattcacttagtagcctccccatctagaatatactccgtgatctttcttgatggccagactgtgtaaaattcatacagtgtttactacagggatccccaaatattgttagttgaatgaacaaac

SEQ ID NO: 1802 - DNA, 898 bp, Homo sapiens
gtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaacaacaggagcactctggaggacacgttttcccacctgttggctcccgtgtctgctgactgagggcattcaggagtaaatgcacaggtcggtccagggcccgtctggggttgggatgcactgacgtcggaggttagtgaaagctttgattcctcttcttcctcttgctgggcctccgcagcatcacaagggtcacatgccctggcatgggcagaaactgggctactgattcttggccacttacccctcggtctccctggtgcaagttctccctc

SEQ ID NO: 1803 - DNA, 915 bp, Homo sapiens
  misc_feature 915: n = A,T,C or G
gggagaatacagtcataatgaacaaaattgcacctctgattgttcaggatctgactttttacttactcgaactgagtattattcgatagcaccaacaacctaagttaacatttaaatgattaacactaaattatcaattacgcaagcattatttttaaaagcacatgtaactaagcttctggagtctgattagtttaatccaagaaaacataaaatgtgaatgcactgttttcatactcactcaatttgggcatgactggctacaatcaggcttaggcactccagggttccaacttttgctgccttgtgtagaggagccttcccctaaaacgtccttaagaatacacattgcacgaaaagagatgaagttgaccagtgaaaagttgcccaattaaccccttttatgcctctgtatctcagtatgctgctaaaaaccaaaaattctttccagatgcaaaaaaggaaaagactgtattaccccccatggttaattttggtgagataaggcatttgcaggcctcttggaagggaaagaattctggaaaaggtagaacccttcgggggataatccccctacgaagggcaaactatcactcttgccaaaacggcacatggcactgatggcaacgcatttagcaacacgtctttgtacaaaacatccgtagggagaaaatctaaccacctaaagacaaaaccctcatccatccctagggaagcggaatggtcacataatggacggggggttggggcgcgacacacccttcctatcatctctccgtgacaatatccggtgggtgggggtacctaactagtgcaaaagaaaagaaaatgccttgagaatatacactccacaagggagaccacgggcagaggataaattaaccccccattaacactatgtctcatgccacatan

SEQ ID NO: 1804 - DNA, 1356 bp, Homo sapiens
ggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaaaaaaaaaaaaaaaaaaaaaaaaaaaaa

SEQ ID NO: 1805 - protein, 284 aa, Homo sapiens; identical to SEQ ID NO: 1527

SEQ ID NO: 1806 - DNA, 1746 bp, Homo sapiens
ccacgcgtccgctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaaaaaaaaaaaaaa

SEQ ID NO: 1807 - protein, 395 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 1808 - DNA, 2801 bp, Homo sapiens
ctggcaaccatttctgtcagctttctcattcctagattgatgcagattgcttaattccttgagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcaaattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgattcaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgattttaaaaaaaaaaaaaaaaaa

SEQ ID NO: 1809 - protein, 527 aa, Homo sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 1810 - DNA, 593 bp, Homo sapiens
tgcggccgcagtgtttttttttttttttttttttttctttttcgcttctcttagactttatttctggatctaggggaaagggacaaaaaatgaaaaaccaactggtaaggttgggtcaacgtgccacaagggggcactgtgtacagggagagtctaggtggcattggaccgctgggtctgagggaggaggggcttttccgaaagacacaaggccctgcaagtacccgttgcagatcaggggccccccagagtcaccgttgcaggagtccttctggtcttgccctccgccggcgcagaacatgctggggtggtacagcgggtcatagagcttactgcagaacctcctcagacaccaccgacacgttcacgcactgcagcacggtaggcattctgccgttcgccagcagaccccagccagaaacgaggcaagagttcccctcggtagggcactgcgaagcaatgctgatgctccggatgggcagactcggacacggattcgtccaactgatgagctgaggtcgttagcgagcaagggtctgtgtactctgggtgccgtacggagaggctggcctccaccatctggctccctggct

SEQ ID NO: 1811 - DNA, 3648 bp, Homo sapiens
cccacgcctaaggtccaggtcccagggctttcccttgcaccttcatccctggccctgcagaggcctgcttctcgcttccggggtcgccagagcgcccctcccgccaccccgccatctcttggccggatcgtgcgagagaaggggaggaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggccccaggtgactccaacaggcaggtctgcctctgtcaggagtgagggtaacacctcctcactctggaatttctcagctgggcaggatgtgcatgccatagtaaccagaacctgtgagtctgtgctgagctctgccgtctacacccacggctgtggctgtgtgaggtctgccacaaacattacctgtcagtcctcaggacaacaaaggcaggcggcccggcaggaagaggagaactcaatctgcaaggcccatgatagtagagagggccgcctgggctaccccctcagtgcccatcagcctggttccggtggtcctaactagccctgtctccttgccaatagccctgtgctccccagccccctcccccatgcagacggctgctatgacatccctgttccttaaagtgcggggttcctcgctgccttctcctccctaactggcaccctgtgcaaacctgctgcagagaacagtgtcttgggcagtgcgatagtcctccagttcaccaacagtaaaaatggtctcaatggggagagatgtctgactgcaagcgctgagtccttccagaggagggctggagggacaggagggcggatcaggtggcctcctgagctggttcctggcgccgatgtaatggatgctgattaccagcggtgagggcatcgtggaagggactgcagaggtgtgcgagatgagtggaatgaggccccaggtgctgatttttatgcccaggatgctcctggctgtcatgggctcccaggggctccaggcatgcacagctcttccgcctcttctcgaagcagaatgccccagaaagggcacctttactatccagggtggctagagtcgccggtggctgtgcgtgggggctgagggctagaatcagggcaaggggctttcagtgaaacgcagagccaggcagggacagcgcggatctcagaacagtctttgtcagatgggacacttcatccccgcggagctgtccgtgcacacagcgttctctgattgccaagctgttaagcactctgcggaagggagctgctgggaaggcggacgaggcatctcaggtgggtgaggggctccgctgcatcagcgttgctcagacccaccatccctggggagctgtcactgacgcccaggtttccccttctcagtacatcctgtgcctcctttctgggctgcctcagtccctcaaaggggagctccccacatgggtgggattattgttgagaacagtcagggtgttgacgaggatgcaggactgaggttgctcccagagtcactcagtgtccctcgttttgctcggagacatcctgacctgggcaagctctttagggagcatctttcctgtctgtgccgcattctccatggcctttgcactctttttgcttttgttttaaacacgtcatcaattcattgcctgcagcagcttgtactgccttttggtttttctttgcagaacagctctggaagtgaagtgtgtgtgtgtgtgtttgcgtgcactactctggactgggtgccttacacgtgttaacacacttgatcagctcagcaacactgtggaataagtgtaatgtgtccattattcagatcaggagactgagattcagagcagggagggaacttgccagagaccacatggcttgcaagcagcagaacctgggtttgaactgacagcggcctgacttcagaacccacgctttcccaccctcctacttcacacccatttgagtccagccatcttggttctgaatcataaccctgactctcctggccacatcctatgctccacattacatgttactctacaggttaccaccctgggtctctttcctatataagaaatagaaatatttgtggaaatcctaatgttcatgacatctctgccattttatcaggaaaaattctatcctaccaaatactggtataatgtacttggcccccctggattggattggtataggttaagagcagatataaggtctgaaataatcccggtattcctagtatgtggaattattatcatggaatcataatggcagtttgcacctctgttgggctctttcaactcctgtgttggctcaggagaatcctatcacattagtccccttttgtagttggatagttgggcttgccagaaggcacacaaatttgggttaactcatttccaggattctggcattgtagacacagaaacaccgactgtgaagttttatgtaatacaaacactgggagatttagcaataggcctgccaggcggccctggcttctggctgcacaacaaaggggggtggctggtgccaaatggggcaacagaaggtgagtttggggcctgcagagcctcgggtagcccagaggagcgagagagtattggctgttcattttaactccatccttggaggattccccaccacaagcctaaggaagtaataaaacctcatgcattattttttgatatctggagagaaacacgtaccctagaaatgctgtggactaattccatggttactttgtcattaaagaaaccaaaatactgagaggtcaccataaacacaaaaaggcagagagagaaggattaaatggtgtttcatgtaaggatctttaaagggagacagaattctagtctgaaaggagcgcaggcagatctggcattttgcttggggagttcaattctttggagaaaatacagagacaaaaagaccattttgatggtatttaaaatatccctctgcccagtgtatctaagtgagtctaaatatattcagcaattttttaaagggcagatattaggcccgattcaaggtatggaatatagattcgaaagggttagtgataggtgagtgcctttcaggtagctttgcatcacagaccaagcccattattgaggactgtacgtatggagcaggcccgtgagcttgtgactgagtttcccaacctgccaggctcccatttgcttaggatgaatatttttctgccctccctggtgagccactgtgggccactcgccactccttacaccccttccctttaatacctcgcttggcttacttgcaaaatccacatgcatcctcctggatctcacagaagatgtatgaaaagtcatggccatgaaaagggcacggaaatcaaattaattaattttgctttttccccacgtttgtttctgtctgtctggtacttttcctttttaagcctgccatctctttgaaagtgagccgcacagtgataatccattttcttcattgtaaccccacagtgtatgtattccacattaaataataaaagggattaataattaaatcaaaatgaaaaaccaaaaaaaaaaaaaaaaaaaaaaaaa

SEQ ID NO: 1812 - protein, 145 aa, Homo sapiens
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 1813 - DNA, 875 bp, Homo sapiens
ttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgaggggccgacagagactacagtaccccgacacgaaacagatagcagtcccaggggttgatccaaaatcaccaaggacctccagccctgggatgaagcccttttccaatcctggaacttattccctggggaacttgggttcccgttccccggtaaccctggttaacccttcaaaggcccttcaagtccc

SEQ ID NO: 1814 - DNA, 448 bp, Homo sapiens
tttttttttttttttttaaagcatttaattcttaccacagtcctttgacatcttattatctccattttacagataaagaaacaggcacagagggtttaagtaacttgcacaaggtcacacaatcacaactagtaaagccagaattaaagtccagtcggtctgcattcaaagcctgtgctcctgccccaaagtgacaattagtgacttaaaggcaagaaaaacagaccctcctctacccaccatcctcatacacagccttccagcccaggatctgaaccatttattcattttctctcatattcattcattcattcaattcttcatcacacatttagtgaagctctgccgtggaatgttcacacagaaggtacaaaaatgaggcaggtgtattttctcccatctaacaggggatgaccacatgaaaagaactggtggcctgtgtgtccca

SEQ ID NO: 1815 - DNA, 1329 bp, Homo sapiens
gggagctacaatgttttgtcattattcactctgatgtgaaaaaggcagtgaatttaatagaaaataacttcgtagagcaaaatctcaggtgtgtttttttagtgccgcagtcttggatgatgggttcctagaagctctcaacatctcttcttaattggagaaagtgttaagccccaaagtagctggagcagtacatcttcaatttttgacaagaaaacaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttttggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaagaaaaaaaaaaaaaaaaaaaaaaaaaaaaaa

SEQ ID NO: 1816 - DNA, 2118 bp, Homo sapiens
ccggtggacccgcgcccacgacctgcgcggcttcctcaacttcacgctggcgcgagccccgtcctccttcgccgccgcgcacaaccgcacgtgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtgaggggtcggtgccgtcacttcctgctgtgtcatcttggtcaaatcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccccagccctctccctatccttgtcagtggctgctctacctccggacactgagtcacatccctcttcctcttgctgcccttttttggggacaggttctttttggaacgaacggaacaaaggatgagcagcccgagggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctttgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtaaaaaaaaaaaaaaaaaaaaaaaa

SEQ ID NO: 1817 - protein, 88 aa, Homo sapiens
RWTRAHDLRGFLNFTLARAPSSFAAAHNRTCRYRAFRDDDGHYSQTYWNLLAIRLAFVIVFEVAEAPAGSPIHGMRPRPCALPNSSTW

SEQ ID NO: 1818 - DNA, 418 bp, Homo sapiens
attactgaacctgtcttgctgtgcctcgaaactctggaggttggagcatcaagttccagccggccccttcactcccccatcttgcttttctgtggaacctcagaggccagcctcgacttcctggagacccccagaccagtgtgcttttcttggagaaagaagaaaagaagaaagaaggaagaagaagaagaaagaaaggaggaagaaggaagaagaagagccagtgtgataatacattgagtgattttttaaaaagtgcatatatgagcaaaaagttatttttcccttttctgaagtatggcagcatactatatagactgtctctgcatgtttatttttcccccatttaatatatcctggagatcattttatatcaatataaaaatggttttctcattcttttaaaaaaaaaaaaaaa

SEQ ID NO: 1819 - DNA, 1492 bp, Homo sapiens
agccccaagcttaccacctgcacccggagagctgtgtcaccatgtgggtcccggttgtcttcctcaccctgtccgtgacgtggattggcgctgcgcccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcttgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctagtaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtgggatacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgttaaaaaaaaaaaaaaaaaaaaaaaaaaaa

SEQ ID NO: 1820 - protein, 261 aa, Homo sapiens; identical to SEQ ID NO: 875

SEQ ID NO: 1821 - DNA, 3226 bp, Homo sapiens; identical to SEQ ID NO: 930

SEQ ID NO: 1822 - protein, 492 aa, Homo sapiens; identical to SEQ ID NO: 931

SEQ ID NO: 1823 - DNA, 1769 bp, Homo sapiens
ggaacctgtccttaccaaattcagagatgacccaagattctactctgtggtatgagggaaagacctctcgatatttatctcacaccaacggctttatcgtaggagcgtcttcgcctcccccgtttccagtagaaaagacagctttgctcctttgaaagcgcagaccgccgcacctccagccccttctccccggggaagtaggccccgctaagaatgtgggaaggtggtggggcggcgactgaagtcgcttccgattggcgttgtcccaaggaagcctgcgcggattgatcggcggcaggcctccaatagagcctgctaggcggattggctgctacgcggctgggccctgtttccggtacctaggcgggcagccatggtgaccggcgagcggcatgcgacgccgcctctgtggcctgtggaggcccgcttggcggcgctgcttcccgacctactggtctttcggaagcctcggggatgggaacccgagctcgccacggcccagggcgtcctcctaggcgtccatgtgacgggtgagggcgacggccggcacttgcacttaagtctcctggcctgcgggagaggcggccgttgggtctaagctcctggaggcctcgacggttacaggcctagcctcccgcgagctaaggcacagtttaacttcgtgctgcggcttccttaggaaactttgagtatcttcgttttagcgtgggaggacatcttttgggatgaaccggctcagtccttgagctcaccccaaagatgatgaaattgaaactcagaggaaaggatttttacaggaccacgccccgggctttgaacccgtttttcccaaccccgagcattttctattaagcgttctgtttcaattattttattcgttcagttaattcgttcttggcgtcataagtatatgcccgccgttgttctggccgtagctatctagcagccactccgcgagtcgttcatttaacaaatacttactctgtgtcagggatatgaagatgggtaataccaggtgcctgtcctcactgtgtgagtggttctctagccagacatgaggagggatcctattgtttcccatagctaggcagcctaagagagtaggggaaagagctggctccagatgaaaagggcaccatctccagctcttggaagcagagagggtggtcctttggattcccagtggcagcagcaaccaacctggcccttagtagtttctaagttacaccatgttaatggataaaggaattactcagcttgaagggatctgtttcctttacactggcctgatgtgtggggagaaaggggccaaaaagtttaggatttggagttaacatcgtaatttctgctttgttggtcagggtttacagcattaatggacaggttcaccctgacctacaagtcggaacgtgacatggacaaactggcccatatcttcagttattacattagtgacatcgtggagcgtgagtgatcattgtagggtaacaaggtgtggtgctgggctcctgggggtttataaaagaagggggccagaagtactttaaaacaggtaccaaagggtcattcctttagcatcattcatctttggtttcttcaagttgccactgaaaagctagacctttgcctattatctgctaatctacccagtctcacattctattgactcattgttcaaagggggggcaggaggagctaatttcctttgcacatttgtattttatttcaaaataaagtattctcttctaacaataaaaaaaaaaaaaaaa

SEQ ID NO: 1824 - DNA, 869 bp, Homo sapiens
tgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaagagggtctatagaacatttgtcagaaatcagatcagccctcaaaaaatggggtctgtgggcctagttaaatagaaataaacttttaaaatatcaccaaaaaaaaaaaaaaagggcg

SEQ ID NO: 1825 - DNA, 2226 bp, Homo sapiens
ggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtcaaaaaaaaaaaaaaaaaaaaaaaaaaaaaaaaaaaaaaaaaaaaaaaaa

SEQ ID NO: 1826 - protein, 394 aa, Homo sapiens
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 1827 - DNA, 374 bp, Homo sapiens
ttttttttttttttaactttaaaaataacattttatttttgatcattcaaaatgtttcaatcaatattctgagcctaaacgtgtaggtgagtgctttctccatctttgcacatgtgaagtgcgcctgaaccatagccccacattttctcaaacaccatcacactcatagaacagaaaggaaagggcagtttcaccagctagcccccatacaccactccctagggtcctccccagcacctgataaatttgggaggcctgattccagggggctggataatgagctggcaaaataaacccagaagaatcgtaattgcagacaaagataaactcaggttccagcacagatagacagcccataccagtgcttttgatat

SEQ ID NO: 1828 - DNA, 925 bp, Homo sapiens
  misc_feature 644, 745, 748, 809, 890, 905, 916, 917, 925: n = A,T,C or G
agcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctangtgcctccaggaggtgagccctgggtgcagctggtctctgaatgacgttacaccctcaccttcttttcctggccctgtctctggactctcccctgtgaggnccnattcccagacagactctcgtcctcaccgaagcttaggcccacatctccccagctgctttangagacagaatggaaaacggaggcgcccctggcagccgccctggccctggtcactgcatgatccgctctggtcaaccccttnccagccagccaaaantggggaatggnntctgtgan

SEQ ID NO: 1829 - DNA, 1863 bp, Homo sapiens
gaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagaggtatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggctggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacagactgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagctaaaaaaaaaaaaaaaaaaaaaaaaaaaaaaaaaaaaaaaaaaaaaaaaaaggaaaaaaaaaaaaaaaaaaaaaaaaaaaaa

SEQ ID NO: 1830 - protein, 418 aa, Homo sapiens [sequence omitted]

SEQ ID NO: 1831 - DNA, 802 bp, Homo sapiens
ggtacggcccgagtcttaggatgtgaatccggaagtgaccctagagaaacgagtcgtggctgaggaccccggcggcagacgcaggttcgggaccatgatgtggattccttttaagatcgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagaggaaccaactcttctggtcctgggtcacctccgaatggccacagagtcatgagctccctgggctgcgcagccggatcctggacactgcagggctctggcttgcctggtagacgccccctgccattgcaccgagggccagccctccagcagcagcagcgagagcctcaggagagcactgctcctggtcactagaggacacatgatccacaaagacgaggccggtgtggacctgcagcgttgcatcgtccactgctgctctctctgagggccactcctctgagtctcccacgcggtcccttctagtcacagtggcaggtcctccagggcattttcctgaagcagctggtttggaactttgggcggtccca

SEQ ID NO: 1832 - DNA, 1625 bp, Homo sapiens
ccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcaaaaaaaaaaaaaaaaaaaaaaaaaaaaaaaaaaa

SEQ ID NO: 1833 - protein, 331 aa, Homo sapiens [sequence omitted]

SEQ ID NO: 1834 - DNA, 2245 bp, Homo sapiens
atctttgtctcccgctggtgctggcacagaagcttgggatccgtctcctctttcgcctcctgcaccttgggagccccgggctactctctcacagcccctgttgccctgtgatctgtaggtccttggggacgcatagtcaaggtgccaggacatcctggaagctgggaaatggctgaatgctatcccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcacctctcaaacaaataaaaaacagacccgggagacatgctacgctcattctgctgaagaaataggcatcatagctgggaaacggattcacaagacccaggctgttccctacatatgtttcctcctccgacgtcagttcatcagtcaatcaagccatgtgagagtggaggccttgtattccctattattcttgggcactctactccaagtaggaaaaggctaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtatctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggcctgaaagacaatatcagtagttttgggaaattctagaaagtgtgcttggaaacgtgggaagagctcttgcctagtgcctaaatgctccatttgcagctctagccaagtagatacttggtaggtatagagccgggtttgcgtttatatcagcaaaacctatgtcagagttgaagaagtagtcaggaaaaagcgtcttggtcgcaggccggggaacatcttaaaagcaaacttctagcctgttgactcttggcaatgagtgttggatcctggctaaagtgccttgaatgcagcatgaggccaatccatgaatccaacttctcatggagaaatgttaatattttttcagtttgaatcaatcagggtgaaactaccatgctattggtttgcttactttttattatttcatgtaaaatctaagacaaaatacattaaatgcctattgacatatgtatttattcttcaccaggctgataatatctgcctaattttaaactttcttccattttgtaggtttcaacttattctattgtaagatactgttaaatctaatagaggcattgtcacttttacgtataattttattttatttcatatatttcctattggctttttacatttaaattatggagcacttcatcatataaaaaacttcaattatatttaaacagtaagtctttggattttttttgccttgtaatttccatattacataataatgagataaacattaatgttttcagggtactttaaattttagataattactcattgtattcatggtgaaatttgtttttactgcatgtgtggtttggaggactgttttcacttctgattcatctttactcttatctcatcagagctcatacctcttgtagttgggggattcgtttataattccataaatggggcaattcataataacataatacaatgagtttgaacgcaggacaggtcttcaagcatacacacatgggcctacatatgtacaacaataataatttataagttactgtttggatggaaagtaaaagtacagaaaatttgttaaaggaaattaaaatggagatcatgtctcataatctctgagcagacaaattagttaggtctcataagtgatctcaacctcgcttgatttgcaatacaacaaacttaaattatttcttgtagctgcatattgaaaaaagagaaatgaagctcaaccgtcagaagtagccacaaccttatataaatagaaactgttcaacaaggtaaacagacaacaaaaacaataaaaaaagttgtgctacccgaaaaaaaaaaaaaaa

SEQ ID NO: 1835 - DNA, 632 bp, Homo sapiens
  misc_feature 9: n = A,T,C or G
cccacgcgntcgggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggtacccacaacatgtaccgggaataccgggacctgaccaccgcaggcgctgtcacccagtgctaccgagacatgggtgcccggcaccgcgcccgagcccactccagttcagatcatgaaggtggaggagatcgcggccagcaagtgccgccggccggctgtcaagcagttccacgagtccaagatcaagttcccgctggcccaccgggtcctgcgccgtcagcacaagccacgcttcaccaccaagaggcccaacagcttcttctaggtgcagggccctcgtccgggtgtgccccaaataaactcaggaacgccccggaaaaacaaaaaaaaag

SEQ ID NO: 1836 - DNA, 5871 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaaggagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccaaaaaaaaaaaaaaaaaaaaaaaaaaaaaaaaaaaaaaa

SEQ ID NO: 1837 - protein, 1325 aa, Homo sapiens
MLPVYQEVKPNPLQDANICSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFKEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 1838 - DNA, 248 bp, Homo sapiens
cccgcttcgagaaggccacaaagtcatgtctgtacacctgtccccctgcttcagggacgtccagatcggtgacatcgtaagtgggcgagtgcggcctctgagcaagacagtgcgcttcaacgtgctcaaggtcaccaaggctgccggcaccaagaagcagttccagaagttctgaggctggacatcggcccgctccccacaatgaaataaagttattttctcattccaaaaaaaaaaaaaagtcgacg

SEQ ID NO: 1839 - DNA, 492 bp, Homo sapiens
cgcgtccggcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgataattcgtccgctcccgaggctgagcagggcggggctgagtaaatgccggcttaccatctctaccatcatccggtttagtcatccaacaagaagaaatatgaaattccagcaataag

SEQ ID NO: 1840 - DNA, 316 bp, Homo sapiens
ttttggtctggggcatttcagatcaacacactttattaaacaccaacagcgggccaggctctgcactaagaacacagagatgaataagacactgtccctgtccctagagggcttacagtctagtaggaaaaaccaggcaagtttcggctaattactgtactgttggattaaggtaaaatgttgagggggagttggtatcctagaccacctaacccagcctggggctttagacagtgcctgaactgagagctagttgtaggttaaaaaaaaaaaaaaaaaaaaaaaaaggaagaagaaataaaagaaaataaaaggt

SEQ ID NO: 1841 - DNA, 405 bp, Homo sapiens
tttttttttttttactttcattttactagaaaccatttattcacacaaaaaaagacagtgactcatgccttgatatgacagactaaaagtacatttcccaaagtttaaataacctgcattcaccgaagaggaaggaagggatctcttaaaactcagagcaaaacaccagcgccttctagcaacccccaacccggcccaacttcctacagaccccgccgtgtccccacgaggactcggagatgggggagggggaacgacagcacactggcggtaaaattgtaacgggacgtttgcatttaccattttccccttattaggatccgctcggccaagtcccggcctcgtccgcagctgcagtggtcgctgggaggtccgagttgaccgtgggaaggaatcgtgaagttc

SEQ ID NO: 1842 - DNA, 846 bp, Homo sapiens
gagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcgattcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccaagagacgaccaaggagcaactgggagagttctacgaagctctcgactgcttgcgcattcccaagtcagatgtcgtgtacaccgattgggacaccggcatcaacgtgtgagccactggagaagcagcacgagacggcagaggaaacaggaggaggcggaatcctagcaggacaccgcttggatcaggacacagacttgggggccatccttgcccctccaacccgacgtgtgtacctcagctttgtccctcacttgcattccctacagcctctgtgctctggcaccagtaccacaacaccacacaccaactaacacaccttccaccgcctcgcacccacacaaccttcccacaccccgttagcc

SEQ ID NO: 1843 - DNA, 326 bp, Homo sapiens
  misc_feature 22: n = A,T,C or G
ttttttttttttttttcttcgntaaaggtatttttattgctagtacaagattgcaggatctaggcaaataatataacaattaaatgtgcaaatctcatgaaggtaaactacctttctgttctgtaatatttacccaaatagtcaaggctcagacttgttaaactgtggagttactaaagaaggggggattttccaaattgtagaaacaagagtagtcagattttcccatccctactagctttctaggttaaattcaatgatgtgaaaacaagcatagggtagagtccatatgatattcatacaggaagaatgtccactggggaagc

SEQ ID NO: 1844 - DNA, 329 bp, Homo sapiens
ttttttttttttttttttactattttaaccacagcatgatagctctttatttctgtaagtcctgctaggaaatcatcaaatcagacggtggtttgggggacctgaacaaacctcctgtaattaatcagctttcagtttctccccctagtccctccttcaacaacataggaggatcctccccattttttctgctcacggccttatctaggcttcccagtgcccccaggacagcgtgggctatgtttacagcgtcaaccttgctgtgtgtgtgcctcatgcattgtggctccagttacctcagtgatctgtagagagtgtcaccttgtgtc

SEQ ID NO: 1845 - DNA, 440 bp, Homo sapiens
ttttttttttttttttttttcctttttttttaaaaaaaggggtttatttccttttttttaagattcagtaggatagccaaattcatagagaataaaattacatgaaagagttacaagctcactgttttaaagacttgacatttttcatttagttttaattaacagtaataagacacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaaga

SEQ ID NO: 1846 - DNA, 3074 bp, Homo sapiens
aacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggaaaaaaaaaaaaaaaaaaaaaaaaaaaaaaaaaaaaaaaaaa

SEQ ID NO: 1847 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 1848 - DNA, 4246 bp, Homo sapiens
ggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatgtcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacgcccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctcccctaccctgtgccagaagcaacagaggtgccaggcctcagcctcacccacagcagccccatcgccaaaggatggaagtaatttgaatagctcaggtgtgcttaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccaaaaaaaaaaaaaaaa

SEQ ID NO: 1849 - protein, 1061 aa, Homo sapiens; identical to SEQ ID NO: 1545

SEQ ID NO: 1850 - DNA, 2486 bp, Homo sapiens
acactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgacctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgatttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccataattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaaaaaaaaaaaaaaaaa

SEQ ID NO: 1851 - protein, 699 aa, Homo sapiens
MTSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHNFHMNTPKYFL

SEQ ID NO: 1852 - DNA, 3124 bp, Homo sapiens
taagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaaaaaaaaaaaaaa

SEQ ID NO: 1853 - protein, 472 aa, Homo sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 1854 - DNA, 391 bp, Homo sapiens
  misc_feature 332, 335, 359, 362, 365, 371, 372, 382, 391: n = A,T,C or G
ttttttttttttttttttttttttatcacaaagtgtatatttatttgtttactggcttattttcagttttctccactacagtacatgagagcaggagacagatctgtatctcaaatgcctagaacagggcctggtgcatacatggcaagcataaaataaaacgttgaatcaatggattaattggttatttaagatggagtgagtcataatgtctaataacaatcacttgaaatgtaggaactgctaaatagcatgcacaaagtcaaaagtggtttctgttttctctaagcacatttaaattttgcaaatgtttcaataatcaccataaattnccnttataatgggaataggggattaantgnttnccaccnnaattccattnggctggggn

SEQ ID NO: 1855 - DNA, 3383 bp, Homo sapiens
gagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgactgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcttctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaaaaaaaaaaaaaaaaaa

SEQ ID NO: 1856 - protein, 480 aa, Homo sapiens
MEVAPEQPRWMAHPAVLNAQHPDSHHPGLAHNYMEPAQLLPPDEVDVFFNHLDSQGNPYYANPAHARARVSYSPAHARLTGGQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 1857 - DNA, 1032 bp, Homo sapiens
tccctaaggggcagcctctcgcgtctcctccagacgcgagtgcattccatcctgaagaaatccgtccactccgtggctgtgataggagccccgttctcacaagggcagaaaaraaaaggagtggagcatggtcccgctgccataararaagctggcttgatgaaaaggctctccagtttgggctgccacctaaaaractttggagatttgagttttactccagtccccaaaratgatctctacaacaacctgatagtgaatccacgctcagtgggtcttgccaaccaggaactgctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagatattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggscacctcagaggaagaggcgagamtamagctaacctggsmggagaagkgaatkcttyaarctttggtcaraaararaagrgggcwawtktctatracaacttccactcccmgtcmcmrawgaatmaaaaaa

SEQ ID NO: 1858 - DNA, 524 bp, Homo sapiens
  misc_feature 382: n = A,T,C or G
ttgcttttttaaagaggcagggtctcactctatcacccaggctggtgtacagtggtgcgatcatagctcactgcagtcttaaactccaggatgcaaacaaccctctcgcctcagcctctccaacagctggtcctacagatgcataccacttctgactacttttttttttgtagagacgggatcttgttttgttgtctaggttggtctccaacttttgggcccaagcaatcctcccaccttaggcttcccaaagtgctgggattacaggtgtgagccactgtgcccgaccaggaacattctacgtttattaaaaggtatatttactcttgtaggtgagggaaggccgacttaaggagattagccacatattcctgaagaaagnattgttgttaactggatttccaggatttaatgatgtacttatttttccttcttcaaccaaattaaacatatatgcaagaattgatgcatgcattgttaaaccagcagtttgtgagtgttgtcacaacagaaaagatatgctg

SEQ ID NO: 1859 - DNA, 1997 bp, Homo sapiens
agcggcctcggaccagccatttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttagctgttgaaaatggacagatagatgtgttaaggctgttgcttcaacacggagcaaatgttaatggatcccattctatgtgtggatggaactccttgcaccaggcttcttttcaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaaaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggactgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggattgactcagtcagcattgacacccttatcttcactttggagtttactaattggaagacacttgcaccagctgttgaaaggatgctctctgctcgtgcctcaaacgcttggattctacagcaacatattgccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacataaaaaaaaaaaaaaaaaaaaaaaaaaaaaa

SEQ ID NO: 1860 - protein, 518 aa, Homo sapiens
MDFTEAYADTCSTVGLAAREGNVKVLRKLLKKGRSVDVADNRGWMPIHEAAYHNSVECLQMLINADSSENYIKMKTFEGFCALHLAASQGHWKIVQILLEAGADPNATTLEETTPLFLAVENGQIDVLRLLLQHGANVNGSHSMCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIPLTNRACDTGLNKVSPVYSAVFGGHEDCLEILLRNGYSPDAQACLVFGFSSPVCMAFQKDCEFFGIVNILLKYGAQINELHLAYCLKYEKFSIFRYFLRKGCSLGPWNHIYEFVNHAIKAQAKYKEWLPHLLVAGFDPLILLCNSWIDSVSIDTLIFTLEFTNWKTLAPAVERMLSARASNAWILQQHIATVPSLTHLCRLEIRSSLKSERLRSDSYISQLPLPRSLHNYLLYEDVLRMYEVPELAAIQDG

SEQ ID NO: 1861 - DNA, 806 bp, Homo sapiens
tctcccagctgccggaccagcgggcctgccgcctctacggaccagtccctgctcaggtgtcacttttgctggcaggccgagattagggcaggagagtgggcaaggcgtcgcggccaggaggagaagggctctaccacgccaccctcctttggcctccgaacgcggaccccgcacacacacacccgcgcctctttggcaagcgtgccttgtcggctgggttaagccgcagtgcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccgcttggtgctgccagtgcgggcagggccttggagcccaaagcggatccccacacttgtccctacggtcggaaggaaagtagaggagagaaatcatgcgcggcagggctaagagcaatagtggcccaaatgttcctggcccgcctgctgcgccacagagtctgaaaagcgggtctccgtctaccagaaggtgacctccacacagcccctctccccgaccaactgcagcacccaaggactggcaacgtggttggagcttttggggggaattatgaagaaatctgaataaatttctcacccttcaaaaaaaaaaaaaaaaaa

SEQ ID NO: 1862 - DNA, 578 bp, Homo sapiens
  misc_feature 162, 167, 174, 263, 467, 474, 493, 563: n = A,T,C or G
ttttttttttttttaggggttaagtgtaaaatgtttattttagtgaaatacaagaaggtgagcaatttccaatttccgtttaacttgacttattaaaaataagtctcattcacattcttctagtattattgtatactgctataaaatttaaaccagaaaagngcttntccttgncagtagctatctgcccaaaaaaatgaatatgacaattccagatctcatctgccatctctaagaaagccacttggaaatgttagataggncccatgggtcctgatccagggatctgtccctgggtccccatcaggctcggttgcaggcagttgcctaaggcgtcttccgccttcagccacgctgcaatccttgctccaggcactgcggcaggttctctccatgcccccaggaagactctccaaacccgaccagctcatttctcctgccccggaggatccagacgccctggcagntcctggnctccagaaccgagaatggnatgctgcctccaatcccaattgccctaagtttctttccagagggccgggagactgctccaagtttgctgnggcgggcgagcggcc

SEQ ID NO: 1863 - DNA, 3022 bp, Homo sapiens
gactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgtcgcaggagcgaagccagggtgtcttctgttgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggttcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaaaaaaaaaaaaaaaaaaaaaaaaaaaaaa

SEQ ID NO: 1864 - protein, 684 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQLNVKTGNHILKSEENILYLLFNPWCKEDMVFMPDEDERKEYILNDTGCHYVGAARSIKCKPWNFGQFEKNVLDCCISLLTESSLKPTDRRDPVLVCRAMCAMMSFEKGQGVLIGNWTGDYEGGTAPYKWTGSAPILQQYYNTKQAVCFGQCWVFAGILTTVLRALGIPARSVTGFDSAHDTERNLTVDTYVNENGEKITSMTHDSVWNFHVWTDAWMKRPDLPKGYDGWQAVDATSQERSQGVFCCGPSPLTAIRKGDIFIVYDTRFVFSEVNGDRLIWLVKMVNGQEELHVISMETTSIGKNISTKAVGQDRRRDITYEYKYPEGSSEERQVMDHAFLLLSSEREHRRPVKENFLHMSVQSDDVLLGNSVNFTVILKRKTAALQNVNILGSFELQLYTGKKMAKLCDLNKTSQIQGQVSEVTLTLDSKTYINSLAILDDEPVIRGFIIAEIVESKEIMASEVFTSFQYPEFSIELPNTGRIGQLLVCNCIFKNTLAIPLTDVKFSLESLGISSLQTSDHGTVQPGETIQSQIKCTPIKTGPKKFIVKLSSKQVKEINAQKIVLITK

SEQ ID NO: 1865 - DNA, 3681 bp, Homo sapiens
tgttgaaattcatcttgatctcctgagctcaagagatcctcctcagtctcccaagtagctgagattacagatatctcttccaaatgcacgatgaaggagttcttgtcaacagcgcaaggcaacagagaagtgttccatgcagggacattgcaaatacatgaaagtcatcacaatggagatttttgctaccaggatgttgataaagatattcatgactatgaatttcaatggcaagaagatgaaagaaatggccatgaagcacccatgacaaaaatcaaaaagttgacaggtagtacagaacgatatgatcaaagtcatgctagaaacaagcctattaaagatcagcttggatcaagctttcattcgcatctgcctgaaatgcacatatttcagaccgaagagaaaattgataatcaagttgtgaagtctatccacgatgcttccttggtttcaacagcccaaagaatttcttgtaggcccaaaacccatatatctaataaccatgggaataatttctggaattcttcattactcacacaaaaacaggaagtacacatgagagaaaaatctttccaatgtaatgagagtggcaaagcctttaattacagctcactcttaaggaaacatcagataatccatttagcagacaaatataaatgtgatgtatgtggcaagctctttaatcagaagcgaaacctagcatgccatcgtagatgtcacactggtgagaatccttacaagtgtaatgagtgtggcaagaccttcagtcagacgtcatcccttacatgccatcgtagacttcatactggagagaaaccttacaaatgtgaagaatgcgacaaagctttccatttcaaatcaatacttgaaagacatagtataattcatactgaagagaaaccatataagtgtaatgagtgtggcaagacctttaggcagaagtcaatccttacacgccatcatcgacttcatactggagagaaaccttacaagtgtaatgagtgtggcaagacctttagtcacaagtcatcccttacatgccatcatagacttcatactggagagaaaccctacaaatgtaatgagtgtggcaagacctttagtcacaagtcatcccttacatgccatcgtagacttcatactggagagaaaccttacaaatgtgaagaatgtgacaaagcttacagtttcagatcaaattttgaaatacatcggaaaattcatactgaagacaatgcttacaagtgtaatgagtgtggaaagacctttagccggacatcatcccttacatgccatcgtagacgtcatactggagagcaaccttacaaatgtgaagaatgtgacaaagctttccgtttcaaatcgaaccttgaaagacataggagaattcatactggagagaaaccatacaagtgtaatgagtgtggcaagacctttagtcggaagtcatacctcacatgccatcatagacttcatactggagagaaagcttacaagtgtaatgagtgcggcaagacctttagttggaagtcatcccttacctgccatcgtagacttcattctggagagaaaccttacaagtgtaaggagtgtggcaagaccttcaatcagcagttaacccttaaacgccatcgtagacttcatagtggagagaacccttacaaatgtgaagatagtgacaaagcttacagtttcaaatcaaaccttgaaatacatcagaaaattcatactgaagagaatccttacaagtgtaatgagtgtggcaagaccttcagtcggacgtcatcccttacatgccatcgtagacttcataccggagagaaaccttacaaatgtgaagaatgtgacaaagctttccgtgtgaaatcaaaccttgaaggacataggagaattcatactggagagaaaccttacaagtgtaatgagtgtggcaagacctttagtcggaagtcatattttatatgccatcacagacttcatactggagagaaaccttataagtgtaatgagtgtggcaagaactttagtcagaagtcatcccttatatgccaccatagacttcatactggagagaaaccttacaagtgtaatgagtgtggcaagacctttagtcagaagtcaaaccttacatgccatcgtagacttcatactggagaaaaacaagtgtaatgaatgtggtgaggtttttaatcaacaagcacaccttgcaggtcatcatagaattcatactggggagaaaccttagaaatgtgaagcatgtgataaagtttacagtggcaaatcaagcctcagaagacaggagaattcatactggagagaaagcttataaatgtgaagaatgtcacaaagtttacagtcgcacatcaaaccgtgaaagacaggagaattcatactggagagaaaccataaaaatgtaagagtttgtgacaaggcttttgggcatgattcgcacctggcacaacatgctagaattcacactggagagaaaccttaccagtgtaatgagtgtggcaaagcctttagtaggcagtcaacacttgtttaccgtcaggcaatccatggtgtagggaaactttactaaggtaatgattgtcacaaagtcttcagtaatgctacaaccattgtgaatcactggagaatccataaggaagagagatcatactagggtaataaatgtggcagatttttcagacattgttcataccttgcagttcatcggtgaactcaacgctggagagaaaccttacaaatgtcatgactgtggcaaggtcttcagtcaagcttcatcctatgcaaaacataggagaattcatacaggagagaaacctcacatgtgtgatgatagtggcaaagccttcacttcacacctcatgagacatcagagaatgcatactggacagaaatcttacaaatgtcatcaatgtgccaaggtcttcagtctgagttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgtttattgttaaagtatggaaattcaactaatttttggtgctgatactgtattgtgcaaatccactgactatgttacttagttccagtagtattttggttggctctttgtgattttctacacagaagattatgtcatctacaaacaaatataattttacttcttactttctg

SEQ ID NO: 1866 - protein, 692 aa, Homo sapiens
MKEFLSTAQGNREVFHAGTLQIHESHHNGDFCYQDVDKDIHDYEFQWQEDERNGHEAPMTKIKKLTGSTERYDQSHARNKPIKDQLGSSFHSHLPEMHIFQTEEKIDNQVVKSIHDASLVSTAQRISCRPKTHISNNHGNNFWNSSLLTQKQEVHMREKSFQCNESGKAFNYSSLLRKHQIIHLADKYKCDVCGKLFNQKRNLACHRRCHTGENPYKCNECGKTFSQTSSLTCHRRLHTGEKPYKCEECDKAFHFKSILERHSIIHTEEKPYKCNECGKTFRQKSILTRHHRLHTGEKPYKCNECGKTFSHKSSLTCHHRLHTGEKPYKCNECGKTFSHKSSLTCHRRLHTGEKPYKCEECDKAYSFRSNFEIHRKIHTEDNAYKCNECGKTFSRTSSLTCHRRRHTGEQPYKCEECDKAFRFKSNLERHRRIHTGEKPYKCNECGKTFSRKSYLTCHHRLHTGEKAYKCNECGKTFSWKSSLTCHRRLHSGEKPYKCKECGKTFNQQLTLKRHRRLHSGENPYKCEDSDKAYSFKSNLEIHQKIHTEENPYKCNECGKTFSRTSSLTCHRRLHTGEKPYKCEECDKAFRVKSNLEGHRRIHTGEKPYKCNECGKTFSRKSYFICHHRLHTGEKPYKCNECGKNFSQKSSLICHHRLHTGEKPYKCNECGKTFSQKSNLTCHRRLHTGEKQV

SEQ ID NO: 1867 - DNA, 439 bp, Homo sapiens
ttttttttttttttatgtaaatcacccagtcttgagtatgtctttattagcagcgtgataatggactaatacaaacctcatatcaagtttaggttctatttgatagacatgtagatcaaagagggtataattatctttagtaagcaaaactaacagcataatcctagacaagaacttatagaaagttcatatccatatatatatatatcccatggttgagagtgctcacaaaaaggaaccattacatccttcttgcctatacttacagatatcatacattacctttaataccttattttctacaaattaaaattttaaccaagacttaattgtcaagcattggcagtggagagcccagctacattagtgtaccaatgatcattgtggaggtttaaatttccagccactttgttttatgcaagagcattattttcttatt

SEQ ID NO: 1868 - DNA, 2725 bp, Homo sapiens
agtaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccgttctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgagaacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaacccccataaacccaacctaagcctatggaatccacagtcacaaaatcgaagttaacccagaatctgtgataagcagcttggctttttttttaaatcaatgcaagtacaccattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatatttttttattcatttgaggatgtcttataaagactgaaggcaaaggtcagaatgcttacgggtgttatttttataagttgttgaattccttaatttagaaaagctcattattttttgcacactcacaatattctctctcagaaatcaatggcatttgaaccaccaaaaagaaataaagggctgagtgtggtgctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggtgacaagagtgaaactgaat

SEQ ID NO: 1869 - protein, 389 aa, Homo sapiens
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFENIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 1870 - DNA, 390 bp, Homo sapiens
gacactggatttttgtgtgagttttttttgaatattttaaaaatagttcttacttattttctatgaaacgtattgggaacttaaaaaatctgcagcattttttgatcattgaaaagtttgttttggtgggaggtgcataaagcaggaactattcaaatttcttgtgttcttcagtatgagaaaggatctttcttctctggtgtatcatgtggaagtataactggggaaaaattggaatgtaggagatcattattagaatcaggaatgcatagtagtcaaaagagaaattgtatttgttgggtaaactgatggaatataggccagcttgtttgacaaagggcagagctgctatatattgtgagcagttctcctgacactcccattgggtac

SEQ ID NO: 1871 - DNA, 2799 bp, Homo sapiens
ctcacacaccctgaagacacagtgagttagcaccaccaccaggaattggccttttagctctgtgcctgtctccagtcaggctggaataagtctcctcatatttgcaagctcggccctcccctggaatctaaagcctcctcagccttctgagtcagcctgaaaggaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatgcctaagatccttgcccttttctggtttgattcccgagagattagctttgaggcctgtcttacccagatgttctttattcatgccctctcagccattgaatccaccatcctgctggccatggcctttgaccgttatgtggccatctgccacccactgcgccatgctgcagtgctcaacaatacagtaacagcccagattggcatcgtggctgtggtccgcggatccctcttttttttcccactgcctctgctgatcaagcggctggccttctgccactccaatgtcctctcgcactcctattgtgtccaccaggatgtaatgaagttggcctatgcagacactttgcccaatgtggtatatggtcttactgccattctgctggtcatgggcgtggacgtaatgttcatctccttgtcctattttctgataatacgaacggttctgcaactgccttccaagtcagagcgggccaaggcctttggaacctgtgtgtcacacattggtgtggtactcgccttctatgtgccacttattggcctctcagttgtacaccgctttggaaacagccttcatcccattgtgcgtgttgtcatgggtgacatctacctgctgctgcctcctgtcatcaatcccatcatctatggtgccaaaaccaaacagatcagaacacgggtgctggctatgttcaagatcagctgtgacaaggacttgcaggctgtgggaggcaagtgacccttaacactacacttctccttatctttattggcttgataaacataattatttctaacactagcttatttccagttgcccataagcacatcagtacttttctctggctggaatagtaaactaaagtatggtacatctacctaaaggactattatgtggaataatacatactaatgaagtattacatgatttaaagactacaataaaaccaaacatgcttataacattaagaaaaacaataaagatacatgattgaaaccaagttgaaaaatagcatatgccttggaggaaatgtgctcaaattactaatgatttagtgttgtccctactttctctctcttttttctttcttttttttttattatggttagctgtcacatacaacttttttttttttgagatggggtctcgctctgtcaccaggctggagtgcagtggcgcgatctcggctcactgcaacctccacatcccatgttgaagtaattcttctgcctcagcctcccgagtagctgggactagaggaacgtgccaccatgactggctaattttctgtattttttagtagagacagagtttcaccatgttggccaggatggtctcgatctcctgaccttgtgatccacccgcctcagcctcccaaagtgttgggattacaggtgtgaaccactgtgcccggcctgtgtacaactttttaaatagggaatatgatagcttcgcatggtggtgtgcacctatagcccccactgcctggaaagctgaggtgggagaatcgcttgagtccaggagtttgaggttacagtgatccacgatcgtaccactacactccagcctgggcaacggagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatggttgaatacagttacttaatgaccatgttatattgcttcctgtgtaacatctgccatttatttcctcagctgtacaaatcctctgttttctctctgttacacactaacatcaatggctttgtacttgtgatgagagataaccttgccctagttgtgggcaacacatgcagaataatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacctgagtataagataaaataaaattttattttaaattttaaaaaaaaaaaaaaaaaa

SEQ ID NO: 1872 - protein, 320 aa, Homo sapiens
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 1873 - DNA, 2063 bp, Homo sapiens; identical to SEQ ID NO: 1330

SEQ ID NO: 1874 - protein, 579 aa, Homo sapiens; identical to SEQ ID NO: 1331

SEQ ID NO: 1875 - DNA, 570 bp, Homo sapiens
ttttttttttttgtgtaagtagattatttattttgtatttggaataaaatttatttatggcttaggatctatgacccctgccttgagagggagaatgggatagggagtgaagggaagctggcggtggatggggcaacagaaaagatgcagcaggcagggccctctcatacactggagggccacatggccaggcctggacccagactctcaccctggctcccaggcagcattggaggtgtggagccatacgtagatgtcacagccacttggacccacttgggcacagtcagactccaaattcagagtatttgggggtagcatatgtcagagaggccagcacacttgctgctgtcttctgtgcagtgtctcaccctcccaaatttgtgttgtcacgtaggcaaaagcagatagacacatgttctatgtggtcatgcaactaaggtgccagctatatatttaacatatcctaggtacatacacgttcacacagctatacacgaagaatctcagccctcgtacttttgcatagtctcatacacgtatcagaagcctccacctggctaacaggaa

SEQ ID NO: 1876 - DNA, 507 bp, Homo sapiens
aagtgtttttttttttttttttttttaaatcaaggcctctttcattaccaaaacaaaacaaaaaaaagggaacaaaatacgatgggagagggaagagatgatgccgaagtgtcatcctgactgactgtccctgcagtgcccatggcgtcccgtgccttattcattctccatcttctttttctgcttccggtagacatagcacgcagcgatggcgaccatggtggattctcccacaaagcccgccaggagggagcccacgcccagggtcgcaccgtgcacccccaggtagggtaggaccacgaggctggcgatgaggacgatgatccgcagcacagagctgggggcaaggacgaaggttttcttcagtgtcatcagccacccggtgagatgcgccctcactgtgactggaactgggaagaaggagaagatccgcaaaggaacaacacagagttctgcaaaggcaaagtccactccgatgatgtctatcaagattttctccctcgtgcc

SEQ ID NO: 1877 - DNA, 405 bp, Homo sapiens
tttttttttttttttttcagaactgcacagtaaatttattgggtggttgtcggttaaaatgacaaatgatgatctgaattcaatacattaaattgctgatacaattgcaaatttcaactgaatttacattgaggcccatcagtggcagttggcaacaactggaacagtttatcacctcagggtatttgcgggcaaggaagatacagaaaacaaaaaaattaggggtatgcaacacagtttaagtgcccagaaataaattttaccacagtgagaacgaaaccacaatgacatgttactaacactgtgcagacgtcatggttgaatgcctgcgttctgttccttcctgatggcagccgccttggttcattagttctcatgtttgcagctccttcacatgccccggag

SEQ ID NO: 1878 - DNA, 5674 bp, Homo sapiens
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttatcaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaatcaaataaaactgtatgaaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttatttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatcgatttattattaaaaccatttataaggctttttcataaatgtatagcaaataggaattattaacttgagcataagatatgagatacatgaacctgaactattaaaataaaatattatatttaaccctagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaataaatattatggatggtgaagggaatggtatagaattggagagattatcttactgaacacctgtagtcccagctttctctggaagtggtggtatttgagcaggatgtgcacaaggcaattgaaatgcccataattagtttctcagctttgaatacactataaactcagtggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacgccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcggcttggtttaatgagtgtgttcatgaaataaataatggaggaattgtcaaaaaaaaaaaaaaaaaaaaaaaaaaaaaaaaaaaa

SEQ ID NO: 1879 - protein, 1104 aa, Homo sapiens
MSFRAARLSMRNRRNDTLDSTRTLYSSASRSTDLSYSESDLVNFIQANFKKRECVFFIKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 1880 - DNA, 465 bp, Homo sapiens
agaactctggatcccccgggctgcatgaattcggcacgtgcgaggaggggtttaggcgtccacatccctggcttcgaaggagcctgacgtttggatataatggaagagcgtgtcaggagtggctcccgttcctgtctccttcagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtctaggagaactggagaagactccacgcccttccagctttggtatctggagatttccagggcccctcgccgccacgtccctgactctcgggtgatcttccttgtatcat

SEQ ID NO: 1881 - DNA, 3368 bp, Homo sapiens
gcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaaaaaaaaaaaaaaaaaaaaaaaaaaaaaaaaaaaaaaaaa

SEQ ID NO: 1882 - protein, 372 aa, Homo sapiens
LRACVRAQMWAPREQLLGWTAEALPAKDSAWPWEEKPRYLGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 1883 - DNA, 3509 bp, Homo sapiens
gcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatatgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctgaagcccagcggggccgagtcattgccgtcttaaaagcccgagagctgactccgcatgggattatgccagtctcctctgtgaaggtatgctgggcagggtggcctgtccgggacatggtctacatggctgcagtgatgtgaggctggcgccagctgcagctccccacagtgtttacaccccgcactttgactaccgagccccacacgggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaaaaaaaaaaaaaaaaaaaaaaaaaaaa

SEQ ID NO: 1884 - protein, 659 aa, Homo sapiens
ISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHMPGAASDRSEHDLTPMDGETFSQHLQAVKILAVRDLIWVPRRGGDVIVIGLEKDSEAQRGRVIAVLKARELTPHGIMPVSSVKVCWAGWPVRDMVYMAAVM

SEQ ID NO: 1885 - DNA, 453 bp, Homo sapiens
  misc_feature 22, 87: n = A,T,C or G
ttttttttttttcttttttttntttttttttaaatcattaaatagtactttttatttaaatgtttataaggcagatctatgagaatnatagaaaacatggtgtgtaatttgatagcaatattttggagattacagagttttagtaaatactcttaatagaggagacataagaaatatttacataaaagctaagtagcatgatacagctcatggttattttcctcataggaaaacaattacttgattttttttttgcataggattaagactgagtatcttttctacattcttttaactttctaaggggcacttctcaaaacacagaccaggtagcaaatctccactgctctaaggttctcaccaccactttctcacacctagcaatagtagaactcagtcctacttctgaggccgaagaatggttcagaaaaataatgattataaaaaataacg

SEQ ID NO: 1886 - DNA, 1248 bp, Homo sapiens
gccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaaaaaaaaaaaaaaaaaaaaaaaaaaaaaaaaaa

SEQ ID NO: 1887 - DNA, 786 bp, Homo sapiens
agcggcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaacgaatgatgatgacagcagctttgtagatggaaccaccaacggtggtgcttggtacagcgtacctggagggatgcaagacttcaattaccttagcagcaactgtttcgagatcaccgtggaggttagctgtgaagaagttcccacctgaagagactctgaagacctactgggaggatac

SEQ ID NO: 1888 - DNA, 307 bp, Homo sapiens
  misc_feature 142, 144, 145, 148, 150, 170, 238, 249, 277, 287: n = A,T,C or G
aaggtatggaacctggctaactgcaagctgaagaccaaccacattggccacacaggctatctgaacacggtgactgtctctccagatggatccctctgtgcttctggaggcaaggatggccaggccatgttatgggatctcnanngangncaaacacctttaacacgtangatggttggggacatcatcaacgccctgtgcttcagccctaaccgctactggctgtgtgctgcaaaangccccagcatncagaatttggattaaaaggggaaagatnatttgtagantgaacttgaagcaagaagtt

SEQ ID NO: 1889 - DNA, 560 bp, Homo sapiens
ttttttttttttttttttgaggctctaaaaatgagatcttttaatggcagattttccagtttctttcatgtttaagcaacacatgactaagcatgccatttcaaacgagtagtgcagaagtaccttgctttcgctttcattggacagaatttccagggcttccaggtgtgacaagccttgatattcatcaaacagcatcccgtagtgcgcggttctctccatcgtgagctgctgtgccagtctctgcttctccttctccttagcttcccttaacatctgcagaaatacacaatgtttgtactctggatgtacatttaaaagcaccgtttcctgtgtaagacatgggggaggtggggaggactgattttgtgttggagagggggagattctggtcactttagaatttctaaaaaatgatttttttgattgatcctattgataacttttacatcatatcctacttcacattttacatgttcattatgtgaaaggcaaaacatagcaaaaattcaatgcctgggaataaactgttaagaaacacaccaaaagctttaacagtg

SEQ ID NO: 1890 - DNA, 1422 bp, Homo sapiens
atgtttaagggaaagtaactttaagagatttttggaaaagctttatatacattcttttcaaatttcagtaaaaatgaaaaagtggttttaatcagtgatttagtagactttgagcaactgtgcacgcttcagtctaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgttcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccaaaaaaaaaaaaaaaa

SEQ ID NO: 1891 - DNA, 1649 bp, Homo sapiens
agacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcaaaaaaaaaaaaaaaaaaaaaaaaaaaa

SEQ ID NO: 1892 - protein, 462 aa, Homo sapiens; identical to SEQ ID NO: 1558

SEQ ID NO: 1893 - DNA, 549 bp, Homo sapiens
gcacgagctcaaaaggcaggacatggaaagtcaaaaggctacaacaggtgccccgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccgctatgagatggcccagatgtgggacccagtaccatgctctaaagcgagtgattaggcagcagctgaagccacccctgctgatgatgagcaagtgcc

SEQ ID NO: 1894 - DNA, 2254 bp, Homo sapiens
aaaaggccaggcgattcaagatggcggaggacctggacgagctcttggatgaagtcgagtccaagttttgcacacctgaccttctaagacggggtatggtcgagcagcccaaaggctgcggcggcggcacccacagtagcgaccggaaccaagccaaggcgaaagagacgctcagatcaacagaaacatttaaaaaagaagatgatcttgacagtcttattaatgaaatacttgaagagcccaacttggacaaaaaaccctctaaattaaaatctaaatcttcaggtaacacatctgtcagagcttccattgaaggccttggtaaaagttgcagtccggtgtaccttggtgggagctctattccatgtgggattggaacaaatatttcatggagagcatgtgaccatctgcgttgtatagcctgtgatttcttggtagtcagctatgatgactatatgtgggacaaatcgtgtgattatctgtttttcaggaacaacatgccagaatttcacaaattaaaagcaaagttgataaagaagaaaggaacacgggcatatgcctgccagtgtagctggagaactattgaagaagtgactgaccttcagacagatcatcagcttcgctgggtttgtggtaaacattaagaatgcagactgcacattcggacagatgcatccatgagagtggtctccatgaatcatcatcatgtttagacattagtccctagcaataccattccctgtgggaaaaggcagtgaattttattgatacaactacatacatttttgaagaccaaatggactaaggaagatcatgtattataacactttggaattattcctgatacatggatgtttcacttagtaacaggcatctacattctttactaatctgtcttctgtttaatagaggtttgattatggagttccatacaaatatctagtttttcattagcaactgcaatattgattgctaatacgtttagcaaatcattccccaacttgtagcagttaaagtggataaagccggccagggcaaagagatcatttaggggtgtctacaacacttcttccagtcagatcttttgttgccaaagatcataatttggacatggcagaaaccaggtgatcagtggctgactgaagggtgttcagaagtagttacaggtattttgcaaaaacactgcctcatagctgatcttacctcatcaactcaaagcaatgttatgcacaatattaaatacatgttaccagttttagcttatttttccctcttttgttcatttaactatcaaaagttattttctattttgattacccaataatatataaaaagagtttgatgcacccaaaatcacaaaaatcctaatacatacaggttattgttggattttccaagtactttctatcctttaatgcctaaaactccatcaagggaagtaaacagcaagtaatataatttttcaggcagcctgtggacttctctggtaggatcaggttgacatatcgtttattaggtgagtaagtgaaaagacaagtaaagcataactgaaccaacaggtaacctgttgggctccttcctgacatcactgagatctgaggagccctacaatagcagcacattcaggaaatcaggtccctcaaaatttctagctcccaaccccattgagagattttgggagctttccaatctgccacaaactccctgctacatatgtactatatagttcaaatgtgtgatacagagcaccctgaaagggaataattgaaacaaagttataatcttcttagtcttatgctaaatttattccagccaccctactgaagggaggaagatctgatcattagaatccttttcctagccatgacacatttacatacttgtaaaatttattgtagtaagtctagcattgcaacagaatagatcttataatggccaatcctcacacttttgtattaaggatattatgacagactaagcatggtagctctcgcctgtaatcccagcactttgggaggctgaggcaggcagatcagctgaggtcaggagttcaagaccagcctggccaacatgataaaacaccgtctctgctagaaatacaaaaattggctgggcgcggtggtgcatgcctgtgatcccaactactcgggaggccgaggcaggaaaatttattgaacctgggaggcggaggttgtagtgagccaaggtcgcgccactgcgctccagcctggacaacacagtgagactctgtctc

SEQ ID NO: 1895 - protein, 207 aa, Homo sapiens
MAEDLDELLDEVESKFCTPDLLRRGMVEQPKGCGGGTHSSDRNQAKAKETLRSTETFKKEDDLDSLINEILEEPNLDKKPSKLKSKSSGNTSVRASIEGLGKSCSPVYLGGSSIPCGIGTNISWRACDHLRCIACDFLVVSYDDYMWDKSCDYLFFRNNMPEFHKLKAKLIKKKGTRAYACQCSWRTIEEVTDLQTDHQLRWVCGKH

SEQ ID NO: 1896 - DNA, 448 bp, Homo sapiens
ttttttttttttttttctgaaaacttctattttaatgtcaactgagaccatgagaggagaacttaccctcttccttctgcaaacaactgtaaaactggttaaaatacatgaagtgactttttcaagcactgaggaacaagcactagacaggcaaagcatcaggaaaatataatctacaatcgagataaaatcagccaatagaaagagacaccaagataattgaaatgtttgaataagtaggcaattttttaaaaagttactttattttttttttacagcagttttaggtttacagaaaaactgatcagaaagtacgaagagtttccatattgccctcttccccacccctacacatccagcttcccctcttatttacatcttgtgttactgtgggacatttgtttcaactgatgaaccaatattaatatatcaatattaaagtccatta

SEQ ID NO: 1897 - DNA, 687 bp, Homo sapiens
  misc_feature 550: n = A,T,C or G
ttttttttttttttttttaaaattttgatctgtttcacacattatatttgtttgaacttcccatgtttaaaaattttgaagaaaatccctggagtagacaatccctagagcactgacatgctgtggtccaaggttcaccaggaacagtgcctgtgccctgccacatggcggggttccttcaagcctctggtgatgaaggtgctcagggaaaggaggacggaggggcgcggaaggacccagccactgctggccaccctggcctctgctctgtgttcacgggggagcagactctggggaggcgcccctcctcaccacggcctgcaggccgggctggagcctgcgccttcaggggccttgcatctccagctggaccccctggcacaggatgtgctgcagtagcccgttgaccacatccagagtctcgtccttctccagcacgatgtcataggagtccatgtagcgctcccgccgctcctccaccttgtcattcaggaagccaattttgagaatgttctgcacaccaggaaccccatcggccatggtgaggtcnccgatagagtctcccagcaggatgacattggttttgccctcaagttgctggaagtaacacagttctcacacacagagctgttcttgttgtatgtgtgtatgagctggcccttaaatccctggagaaaacatcttcat

SEQ ID NO: 1898 - DNA, 3370 bp, Homo sapiens
gcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggtgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggaggtgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacgctgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagtgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacgtggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcaccgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggaaaaaaaaaaaaaaaaaaaaaaaaaaaaaaaaaaaaaaaaaaaaaaaaaaaa

SEQ ID NO: 1899 - protein, 845 aa, Homo sapiens
QFVQPEERRQGSLLGPGLPSHALGTLAKVAGRQDAAPPGGSAASEEREEGPSVEALAVSKADCYVQLWLPTASPSPAQTRIVANCSDPEWNETFHYQIHGAVKNVLELTLYDKDILGSDQLSLLLFDLRSLKCGQPHKHTFPLNHQDSQELQVEFVLEKSQVPASEVITNGVLVAHPCLRIQGTLRGDGTAPREEYGSRQLQLAVPGAYEKPQLLPLQPPTEPGLPPTFTFHVNPVLSSRLHVELMEVLAAVQSGPSAELEAQTSKLGEGGILLSSLPLGQEEQCSVALGEGQEVALSMKVEMSSGDLDLRLGFDLSDGEQEFLDRRKQVVSKALQQVLGLSEALDSGQVPVVAVLGSGGGTRAMSSLYGSLAGLQELGLLDAVTYLSGVSGSTWCISTLYRDPAWSQVALQGPIERAQVHVCSSKMGALSTERLQYYTQELGVRERSGHSVSLIDLWGLLVEYLLYQEENPAKLSDQQEAVRQGQNPYPIYTSVNVRTNLSGEDFAEWCEFTPYEVGFPKYGAYVPTELFGSELFMGRLLQLQPEPRICYLQGMWGSAFATSLDEIFLKTAGSGLSFLEWYRGSVNITDDCQKPQLHNPSRLRTRLLTPQGPFSQAVLDIFTSRFTSAQSFNFTRGLCLHKDYVAGREFVAWKDTHPDAFPNQLTPMRDCLYLVDGGFAINSPFPLALLPQRAVDLILSFDYSLEAPFEVLKMTEKYCLDRGIPFPSIEVGPEDVEEARECYLFAKAEDPRSPIVLHFPLVNRTFRTHLAPGVERQTAEEKAFGDFVINRPDTPYGMMNFTYEPQDFYRLVALSRYNVLNNVETLKCALQLALDRHQARERAGA

SEQ ID NO: 1900 - DNA, 4536 bp, Homo sapiens
ggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggtgaggcccgtgggcaacccagccaggccctgcctccagctgggctgagccctctgtttacaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaaaaaaaaaaaaaaa

SEQ ID NO: 1901 - DNA, 2854 bp, Homo sapiens
ggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacggcttcagaacttgatgatgatgttccaaaagcaaactgcctctccactgaaagcactgacactccgaaggcccctgtcatcactcttccctcagaggcaagggaacaaatggccacccttggagagaggacgttcaactgttgctacccaggttgccacttcaaaactgtccatggcatgaaagacttggaccgccatctcagaatccacacgggagacaaaccgcacaagtgtgagttctgtgacaagtgcttcagccggaaggacaacctgaccatgcacatgcggtgccacaccagtgtgaagccacacaagtgtcacctgtgtgactacgctgccgtggacagcagtagcctcaagaagcacctgcggatccactctgatgagcggccgtacaaatgccagctctgcccctatgccagccgcaactccagccagctcaccgtccacctgcgatctcacacgggggatacccccttccagtgctggctctgtagcgccaagttcaaaatcagctcggacttgaaaaggcacatgatcgtgcactcgggggagaagcctttcaagtgcgagttctgcgacgtccgctgcaccatgaaggcgaatctcaaatcgcacatccgcatcaagcacaccttcaaatgtctgcactgtgccttccagggccgggaccgggctgacctcctggagcacagccggctgcaccaggccgaccacccggagaagtgtccagagtgcagctactcctgctccagcgcggccgccctgcgcgtgcacagcagagtccactgtaaggactgtcccttcaagtgtgacttctgcagcttcgacacgaagcggcccagcagcctggccaagcacgtcgacaaggtgcacagggacgaggccaagacggagaaccgggcccctctgggcaaggaagggctcagagagggcagctcccagcacgtggccaagatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtaaaaaaaaaaaaaaaaaaaaaa

SEQ ID NO: 1902 - protein, 645 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDCPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 1903 - DNA, 972 bp, Homo sapiens
tgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtctcattaaagcatgctcttaaggagtacatatggtcattaattgccaactgtagattccagtgatctggcccctgcctacctccttcctctctttttcattctctgtcatgcttctccactgttttccccaatgatgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcatcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgcgaaaaaaaaaaaaaaaa

SEQ ID NO: 1904 - DNA, 3324 bp, Homo sapiens
aaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcaaaaaaaaaaaaaaaaaaa

SEQ ID NO: 1905 - protein, 158 aa, Homo sapiens
KFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 1906 - DNA, 713 bp, Homo sapiens
  misc_feature 627, 685: n = A,T,C or G
ttttttttttttttttttttaataaatacaattccggatttattaaaaatcagggctcccctgctgtgccctcctggcactaaggaaataaataaccagagggggcacagctaggtaaagggggaaaaaaatcagatctcaagacagactctttgaactaccctttttccctccccaatttcccacccccttatggctcttgggacatagcacctgagcaggcacctcagtccgtgtagagtgtgaccggcaccaaggcatgtctgccctacccaagaagggagacaggccctggggtcacttgtttccagcccttcatgaccccaagacctgttccccacaggggccagggctgaagcaccaattggaggcacctgaggggtggtggctgggggagggaggatggggtaacaaaacctatgcagcaaaagcagctgacgggggtccggccccctctccaagttcagccagtgcctgactgaggtcatgccccatcgtcctttcccctcgaaccccacctgcactcagctgaggatctttccgggcagttcaacagcagcacggatgaagactgcatcatcccgcacatagtttcgctttcgaatgtcctgggtggagatgaacttnggataaccaaagcccagagaactctcattcagggagcccccgcacgtgccttgcttcntgaaattcttccaatttgggtcgtggtg

SEQ ID NO: 1907 - DNA, 692 bp, Homo sapiens
  misc_feature 295, 660: n = A,T,C or G
tttttttttttttttttttgagggtaaaatgggcattttattacacacagtagcataaatgggataagaataaaatctggagcgtctctgtaccaattctccaattaatagctgctcaacctaaatatctttgtcttagtccagggtgagaaatgggatctcatgtaaaggaaacctggggtccagtccagtcctactgaatgctatttagtctgagtaaagaaatgtctgagggtcaaagccatttgggaggtctccctggggatagagaggttgtcctaaataggtccatcanaaaagccaggaatctctcaggcccacaaggcaataaaggccatgaaggcaaaaccagcggctacacagctccacttagctagaggggcctcaggactagctagctcccgtggaagaatttctaggaaggtgacatacaggaaggtaccagctgccacaccctctaacacagcctgggctaagccccgccctccttcagagtcccctccagtcacagccagccctacggctaggcccaggggggacatgagagctaataatagtatggagaacactgcccatcgtgagctggtacctaaatgcactagccgcattcctacaccaaacaccacaagccccttatgagccaggacagcaaggcagagnctgacggtagctgctactgtcgctgcagcccc

SEQ ID NO: 1908 - DNA, 469 bp, Homo sapiens
gcggccgcgcggctgactgcgactcgggagctccgggagcggcccgcgcagtgattgctgccttgaccgtccctgctcttgaagagcaccagcgaaagcagccagtctgagatattgacactacagaaaaaactgacagcttactccttgtattgattctactcttctctacaaatatagactccgttccctaccacagccttgcctcagaattcactgtgctgaggagctaacaggatcctgacatttaattgtctctgcctgagcattctgtcaactttggaacttgtatgagcacagacggggtttcaccgttttagacaggagggtcccgatctccagacgtcgtgatcctcccgccttgcctcccaaagtgctgggattacaggcatgagccaccgcacctggcccaacaagcattcttttcacaacatgtttagtgccctgtttgcctcatttttgtgcttat

SEQ ID NO: 1909 - DNA, 761 bp, Homo sapiens
gctcttccagaggcaagaccaaccaagatgagtgccctgggagctgtcattgccctcctgctctggggacagctttttgcagtggactcaggcaatgatgtcacggatatcgcagatgacggctgcccgaagccccccgagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggaggacaggtgacaatatacacatgtgcgctaatcgtaaaatgagcatcttagtctttaaaacacatcagaattgaatacgaataatctatttgtcgatgaaataaacacaactctttgagtaaaaaaaaaaaaaaaaaaaaaaaaaaaaaa

SEQ ID NO: 1910 - DNA, 2210 bp, Homo sapiens
ctgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtctgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggccgcgcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttctcagtttagcataacctcttatggattttcatcaaattcagcgtgttggtcactggaaagagccttttccttctccttttcttactctcccctcatggtgttcccctcttaaaggagaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaaaaaaaaaaaaaaaaaaa

SEQ ID NO: 1911 - DNA, 4767 bp, Homo sapiens
agcggctgggggatactggactaaacagcccctcccccccctttttttttctgaggcggagtctcagtctgtccaggctggagtgcattggcgcaatctcctctcactgcaacctctgccgcccaggttcaagcgattttcttgcctcagcctcccaagtagctggtattacaggcgcctgccactgtgcccggctaatttttgtatttttagtagagacggggtttcatcatcttggccaggctggtcttgaactcctgacgtggtgatccacctcggccgcctaaagtgctgggattacaggtgtgagccactgtgcctggcctctctcttttttttttttaaactaagtttatattatgaatatacgaatgtttatcaaaatgcttaccatgtgccaagccctggggatgttttgtatactagaaaaggaaaagaataatgtgttacttgcttccttgagatcctaatatttaaaagtactagccaaaattgtaaatgataattaaattggttgattgcaccctcagtagtacattagtattgttataatattgtgacttttttcaactgcagtgagagtagcatgtttgtctccaagagacgtttcattttgaagacatgtggtaccaccctcttgctgaaagcactggttcccctgttgaagcttgctagggattacagtgggtttgactcaattcaagtaagtaagcaaacatttaaatatttttcaggcataaatgttagcgttcttatcctgtaatatgcgaagtaaataaatttatatacttactgcctttgttacaatgcatgcaaacacgtggtaaggtgttcataccttaggaagagatctgattctcaagaacagcagaaaataggaagcagagaatgagttaggatgaaattcaaatgggagaaagaaatgaagaagccagatacttccagtagttaatttcttaacatggctacttataataatagagaaatggtaagaaaagaaggaaaagcaagaaaaatgtcgttactgaaattgtccagtctttataatgaagagttaggatgaagagcaacagtcagtattgagttaaattcttatacttttcaagaactaaggtgtttttacctagggtataattttctgattagcagttgttacattttatttattttctatttttttgagatggagtttcgctcttgtttcccaggctggaatgcaatagcacgatctcagctcactgcaatctgcacctcccaggttcaagtgattctcctgcctcagcctcccaagtagctgggatcacaggtgcccaccaccatgcctggctaattttttttgtatttttagtagagacggtgtttcaccatgttggccaggctggtctcttaactcctgacctcaggtgatccacccacctcagtctcctaaagtgctgggattgcaggcgtgagccactgcacccggcctgaattttaatctttaacttcataaggaaaggatggattgtcattagtactcaatacagtttttgttgttatgaattgatccttgtaagaaatctaaagcaatgtgtgcttaaccgatgcttaaaactaatatgttattccccccaaatttttgcttatatgactattaataagctcagtttagaaactactgttctagaaaggaatatacttggtgttaatagttgttatgacccatcatcactagactgggctttttaaaaaaaagagagagaaagagagatggggcctcagtatgttgcccaggctggactcctgggccaagtgatcctcctgcctcctaatagcgagactacaggcatatgctaccatgccaagctaaaatatttgagttttgattttgccgagtttttgatatgtggacaatagttgattagcttcgaaaagtgatagaattctacatctaaagtcatctttttttttctttcttttcttttttaataaagagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaagaaaaaaaaaaaaaaaa

SEQ ID NO: 1912 - protein, 217 aa, Homo sapiens
MKPSHQGYPHRNFQEEIEFLNAIFPNGAAYCMGRMNSDCWYLYTLDFPESRVISQPDQTLEILMSELDPAVMDQFYMKDGVTAKDVTRESGIRDLIPGSVIDATMFNPCGYSMNGMKSDGTYWTIHITPEPEFSYVSFETNLSQTSYDDLIRKVVEVFKPGKFVTTLFVNQSSKCRTVLASPQKIEGFKRLDCQSAMFNDYNFVFTSFAKKQQQQQS

SEQ ID NO: 1913 - DNA, 723 bp, Homo sapiens
catgattgcgcacatacgggcctgaagccggtgactttatacacactttgggagatgcacatatttacctgaatacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagcttgaaggatattgtcagtctttaggggttgggctggatgccgaggtaaaagttctttttgctctaaaagaagaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctatttcctcaaatctgagggagctggagtacaccatcgatcatgatgtagagggtggttatgaaccttatagatgctgcatatgccgctattataaagaagtgggctg

SEQ ID NO: 1914 - DNA, 1557 bp, Homo sapiens
tttactaaatgtttcatttactgaattgtttcatttattccttaaaacaactcagctctattctcggagccgttacttgcagctcagcattgttataaggaataaatgaaacaaaaagtacttaacatagtgcctccacataagatgtcacaagctgctaactactatttttgttatgcattgtctgaagataagtcacaaagttggttcttagctttcaggtaactaatagtgaagggagaaaagcaaccacttaaagaatttacaggccgggcgaggtagctcacacctgtaatcctagttctttgggaggcagaggctggtggattgcttgagctcaggagttcgagaccaacctggtcaacatggcaaaaccccatctatacaaaaaatttgcagggcgtggtggtgcgggcctgtagtcccagctacctggggggctgaggtgggaggattgcttgagcccaggaggtcgaggctgcagtgagccaggatcgagccactgcattccagactgggtagcaaagtgagaccctgtctcaaaaacaaaacaaaacaaaaaaagaatttatagtttccaaggtgaaacaaacaaaccagctgcttaggagaacacagctgattttaacatgttctgaggagcacaatttttcttgctggtactcatgaagaaaacatcttacttcatatttaaaggtatttttaatgtgaatagagtcaaaataatttataaaagtggtctttggggtccagattgatgtgttctaattatgagcctctgtgatcggacttaattcaaagatagatttttgaggggctagaggaatggattgaactttaggaatttctatggatattgtttctcttctctgtgcttttgaaatggcagtgagtgagtctggcattggtaggtgatgctcacacttatgcattccagtgataactttcgtcaagttcaagactgttttggaaaatttctgcataactttgttgagttttagaattctatttgcagttaaaatttttattttaattgtgaaataccaaatctgaagttgtattttaatattctttaagctatagaagtcagtacaacagttaatttttccttagtattaaacatccttataccatagtgtaaaaatgagaaatttggaatatctcacttttatttactatgttaaatgctccattccttctccccaccaggcacacccacataaaaaaagatttttggaaagatgttatagggcagagtgtgttaagagatgagccgggcataatggctcatgcctgtaatcccagcactttgggaggccaaggcaggcagatcacttgaggtcaggagtttgagagtagcctggccaacatggtgaaatcccgtctctactaaaaatacaaaaattagctaggtgtggtggtgggtatctgtaaacagcctggctaacttgcaaggctgaggcaggagaatcgcttgcacccgagatgtggaggttgcagtgagccgagatcgcaccactacagtccggcgtgggtgacagagcaagcctctgtctc

SEQ ID NO: 1915 - DNA, 2427 bp, Homo sapiens
agcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacggaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaaaaaaaaaaaaaaaaaaaaaaaaaaa

SEQ ID NO: 1916 - protein, 378 aa, Homo sapiens
QGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPIPIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 1917 - DNA, 1963 bp, Homo sapiens
agatagctgttctccagcctttctggagggatgcagagcctttccttaggacaaacaagcatttcaaaaggtttgaactacctaaccattatggcaccaggaaacctctggcatatgagaaataactttctctttggttcaagatgttggatgactcgattttcagcagaaaacatcttcaaatcagtttcatttaggctttttggtgtgaagtgtcataatacagacagtgagcctttgaaaaatgaggacctactgaaaaacttacttactatgggagtagatattgatatggcaaggaaacgacagcctggagtttttcataggatgattaccaatgagcaggacctgaagatgttccttctttccaaaggagctagcaaagaagtgatcgctagcatcatatcaagatatccacgagcaataacacgtactcccgagaatctttcaaaacggtgggatctgtggagaaagattgtgacatcagaccttgaaattgtaaatattttggaacgttctcctgaatccttttttcggtccaataacaacctaaacttagagaataatataaagttcctctactcagttggattgacccgtaaatgcctttgtcgattgttgaccaatgcccctcgtaccttctccaatagtcttgatctgaataaacagatggttgaatttttgcaggcagccggtttgtcattgggtcacaatgatcccacagattttgtcagaaagataatttttaaaaacccttttatcttaattcagagcaccaagcgggtgaaagctaacattgaattcttacggtcaactttcaatttgaacagtgaggaactgctggttctgatatgtggtccaggagctgaaatcctagacctttccaatgactatgccagaagaagctacgcaaacatcaaagagaagctgttttctcttggatgtactgaagaagaggtacagaagtttgtcttaagctatccagatgtgatcttcttggcagagaaaaagtttaatgataaaatagactgcctcatggaagaaaacattagcatttcacaaataatcgaaaatcctcgggttctggattcaagcataagtactttaaaaagtcgaatcaaagaattggtaaatgctggctgtaacttgagtactttaaacatcactcttctatcttggagtaaaaaaagatatgaagctaaattgaaaaagttaagcagatttgcctaaggatgccaatgtttttaattctcaggaactgtgaatatgttatgccacattgcaaaagaattttgcagaagtgattaatttaaaatgttattaagggccttgagatggggagattatcctgaattactttggagggcctaatataattgtagggatctttaaaagttgaagagggaggcaaaagaggaggtcagagtgatcctgtataagaaagacaactacttttgaaggaagttaaaaggtggctttgaaggaggaagacaccttgagccaaggaatgaagggggcctgtaaaaaaagattgaaaaggcaaggaaacagattctccattagagtccccagaaaggaatgcagccttgctggcacctttttagcccagtgagatcaatgtcaaacttctgacccacagaaccataagatggtaaatttgtgttgttttaaaccactgagtcagtgataatttgctgaagaagcaaatagattaacatagcaactaagtagatgattagttgcattataggtgaagtcaaaaatacagtcctttagtaaagtctctatttcttccttttataagagtaattatatttaaaaaatctacctacccttctggaattgctaatgttagtgtttataaagtcttaaatgtgggcataaaaaactaaatgtgaatataaaatctaaataaaggaatatgtttgcctaaaaaaaaaaaaaaaaaaaaaaaaaaaaaaaa

SEQ ID NO: 1918 - protein, 399 aa, Homo sapiens
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPTDFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 1919 - DNA, 1847 bp, Homo sapiens
cagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgctgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgaccccgaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttccccccc

SEQ ID NO: 1920 - protein, 520 aa, Homo sapiens
MSLLSLSWLGLRPVAASPWLLLLVVGASWLLARILAWTYAFYHNGRRLRCFPQPRKQNWFLGHLGLVTPTEEGLRVLTQLVATYPQGFVRWLGPITPIINLCHPDIVRSVINTSDAITDKDIVFYKTLKPWLGDGLLLSVGDKWRHHRRLLTPAFHFNILKPYIKIFSKSANIMHAKWQRLAMEGSTCLDVFEHISLMTLDSLQKCIFSFDSNCQEKPSEYITAIMELSALVVKRNNQFFRYKDFLYFLTPCGRRFHRACRLVHDFTDAVIQERRRTLTSQGVDDFLQAKAKSKTLDFIDVLLLSEDKNGKELSDEDIRAEADTFMFGGHDTTASGLSWVLYNLARHPEYQERCRQEVQELLKDREPKEIEWDDLAQLPFLTMCLKESLRLHPPIPTFARGCTQDVVLPDSRVIPKGNVCNINIFAIHHNPSVWPDPEVYDPFRFDPENAQKRSPMAFIPFSAGPRNCIGQKFAMAEMKVVLALTLLRFRILPDHREPRRTPEIVLRAEDGLWLRVEPLG

SEQ ID NO: 1921 - DNA, 1957 bp, Homo sapiens
ttgtatactgtaaacttgtatagtatgtgaaaactttttacatgggaatcttggaacaaagtcttagatgtctaactcgtttgctaactctgaggatgtggaggatggatatggacataggaagttcaacatgtgtatcatggagtgggatatgtaggtgtgtaatctatgatacagtttcagatctgagagtttctagtggttctagagaagagaacaggatggatctggagctgttgttaattatttgtaaagtcctattttgaagtgtgattgctttttactcttcagcatctcctttggaaatcttatccctctactttcctgcagggagtttgttttgggtggatcagtaaagaggatgcaattggggcctcaacttcttttctcattgaggaaagagtgaggggtgctgctgagagctcagtgcttctacagtagccatatttgaaggtttgcttagaggtaatgctggagcgtacacaaattgccttcaagattccagtagtttgtgatttaaaaatttgtttgagcagttaacatgggtatattcagtttgtttatttttgttagcagtttgtgttcccaatggaaaacagcgtgagaaagagttgctagagtatagaattgtaagtgcttccctagcgtgttcttggacttcagattgttcaccttttttttttttttgtcccttcttggtttgtttgtttgaacttgagccctttggtgtgacaagtcacatacagcttttcaggatctaagtttatggttacataagattattgtttatatgtttcagaagctttgctcacttgtttattcattcatttcataaatattccttgaaatgcttactgtaagcaagattatgcagggcatgttattaggtggtaattagggaaagggaaaaatggaaattatattttgcagatacaacaaaggctgaagaggtgtgtgtgtgtgtgtgtgttttagatacacacacatctatatgtacacagagacacgatccacagttgtgtaggaataacttcctaaacatctttaggatctacctctttttcctgttcccactgttatttctttgtttcaggcccttaacatctctaatatacactagtatttctgtcttcacactgttttttttctttacacagctcttttcatagcccctccattagcacacagattggaattgtgtctccttgttacccacagaataaaacccaatgttcttaatatgtagtcttaatatagactctataaatagcccctttgttaatctatcttgaattactcacttttaggtttcagctccctactgagaccccaactggctttaccttctgttccctcctggttctgcttatcttccattgcccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagtctgtagatgatagcagcttcaggaggttgcactatcttttgactgtgcccacacccttcacaccttgtaaatagtccctttcttaaactctccttaaattacccagtttgggggtgctatctgtttcctgctgggatcctgatggctgtgttgcccaaacctaaatgtcagtcatgcttgcagttacagctgtgttattttcctgtagtactgatttccctcttttattaaaagttctgtggtggctgggcatggtggtttatatgtgtaatcccagcactttgggaggccgaggcaggaggattgcttgagtccaggagtttgagaccagcctaggaaacatagtgagactctgtccctacc

SEQ ID NO: 1922 - DNA, 2255 bp, Homo sapiens
gagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1923 - protein, 340 aa, Homo sapiens [sequence omitted]

SEQ ID NO: 1924 - DNA, 480 bp, Homo sapiens
ggtcgacttttttttttttttttttttttttttgggtttttttttttttttttgctcaaaaatctttttactgataggcatggctacacaatcattgactatgagaggccagaggagaatgaggcctggcctgggagccctgtgcctactagaagcacattagattatccattcactgacagaacaggtcttttttgggtccttcttctccaccacgatatacttgcagtcctccttcttgaagattctttggcagttgtctttgtcataacccacaggtgtagaaacaagggtgcaacatgaaatttctgtttcgtagcaagtgcatgtctcacagttgtcagtctgccactccgggtttattgggtgtttggttcctttgagatccatgcatttcctggttgaatctcctgggactcccccattagggatgaaatagcacgatgcattgcataaagtcaccaagggggcaaagatcac

SEQ ID NO: 1925 - DNA, 2322 bp, Homo sapiens
taccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcggttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccat

SEQ ID NO: 1926 - DNA, 4828 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgccggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaattttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccataaaaaaaaaaaaa

SEQ ID NO: 1927 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 1928 - DNA, 1054 bp, Homo sapiens
gggggggcaaaaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacagtggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttggaaaaaaaaaaaaaaaaaaaaaaaaaaaaaa

SEQ ID NO: 1929 - protein, 191 aa, Homo sapiens
GGQKKIKVFGPGTKLIITDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITVDPKDNCSKDANDTLLLQLTNTSAYYMYLLLLLKSVVYFAIITCCLLRRTAFCCNGEKS

SEQ ID NO: 1930 - DNA, 6975 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagagaataacagcacctggccgggtgcagtggctcaggcctgtaatcgcagcactttgggaggctgaggtgggcggatcacctgaggtcaggagctcgagaccagcctggccaaaatggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa

SEQ ID NO: 1931 - protein, 410 aa, Homo sapiens
MDVMELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 1932 - DNA, 1181 bp, Homo sapiens
cacgaggctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttcgccgaggcggcgtgcccggaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcaaaaaaaaaaaaaaaaaaaa

SEQ ID NO: 1933 - protein, 268 aa, Homo sapiens
MAQPLCPPLSESWMLSAAWGPTRRPPPSDKDCGRSLVSSPDSWGSTPADSPVASPARPGTLRDPRAPSVGRRGARSSRLGSGQRQSASEREKLRMRTLARALHELRRFLPPSVAPAGQSLTKIETLRLAIRYIGHLSAVLGLSEESLQRRCRQRGDAGSPRGCPLCPDDCPAQMQTRTQAEGQGQGRGLGLVSAVRAGASWGSPPACPGARAAPEPRDPPALFAEAACPEGQAMEPSPPSPLLPGDVLALLETWMPLSPLEWLPEEPK

SEQ ID NO: 1934 - DNA, 294 bp, Homo sapiens
  misc_feature 165, 221, 232, 241, 271: n = A,T,C or G
tttttttttttttttttttttttcctctgaaatggctttatttccccagtgtgaggaatctgtgagtggtgaggggtctgtggtccctgttaccccaaggaccctgcagcctccagatggataacggcccgggatccaggccttgatcctcccaggctgggactnggttctgggaggagccgggcatgctgtggtttgtaaggatgacactcccaaaggtnggtcctgacangtggcccanatggacatggggctcacctcaaaggacaanggccaccaggtgcgggggccgaa

SEQ ID NO: 1935 - DNA, 300 bp, Homo sapiens
tttttttttttttattttacagtatattttgagaaagatctttatttgctttgtacaaagtaaaaattacatgacacattaacatattatatatcaacatgatacataattcataaaacactgtctgccaaaagtaattttaccagtttttttttttttaaaaaaaaaaccatctaaaagtggttttttaatatatatattttttccaaaggaagaaatttcttgcttttactcagggaaaaaaaaaaaaattaaggtacatttgagtagaatgatttcatctaaaagagttctttcagg

SEQ ID NO: 1936 - DNA, 493 bp, Homo sapiens
  misc_feature 266: n = A,T,C or G
cacgaggcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctanctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttgcaccccatgctgttgattgctaaatgtaacagtctgatcgtgacgcttaataaatgtctttttttta

SEQ ID NO: 1937 - DNA, 730 bp, Homo sapiens
ctaaagggataagcttgcgaccgcaatcgttttttttttttttttttttttttttttttttttttaaataataaatgaaagattttattcatctttgtagataacaagcactcaaaggttaatgagtgaaggagataaccatctcctccaaacaaagaggctcttaataacgcaaaagcaaaaatctttccacttttagatgaaaacaaactaaaaaataacttcaggcttcagatatggaaataaagcaccatttttcaaatggtagacttggcttacttaaaataagtaaatagccccagactatctgaaaaagaaaaacatttcaatgccccttgtgagttctaattacatggctacatgttaaggaacatctcaaatctctctctgaacctactagtaaacaaaaattatacagatatatatacaaatgtagtcttccatttcatttttcatttgcacaagcttccagctatttaaccaggtgacaaatcaaagtgacaagatgcactaatattcgtgagaactttaaattttaaaagctagtatttaattacccttagtgagctcatttacttacattaaaaattatgcgatcagtcatgatttttctttagaccatttaataatacacatggactaacatttatcatgctttgttcaggacctccttacaatcatatcccttgtatgacttactcttcacataatcccttgccagtaaaagtga

SEQ ID NO: 1938 - DNA, 4147 bp, Homo sapiens
ttcggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaaccaataaaaatgctggaaacaagaaaaaaaaaaaaaaaaaa

SEQ ID NO: 1939 - protein, 1243 aa, Homo sapiens
MLASPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKLSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRM

SEQ ID NO: 1940 - DNA, 617 bp, Homo sapiens
  misc_feature 224, 226, 322: n = A,T,C or G
ttttttttttttttttctcttaacaatttttattgaagaaaaaataggctgctttgcaccttaagtgctcctctgtcttctctcctccctccaaccaacccctgccagccccacactctcatcacaaaatgggggaatactgcagtttttaagatccataaattaattaccaaataatacacaagacctgggtgaggccacatgagaacactttggagaagtancnttttttttttttttttttttttttttttttgagacggagtcttgctctgtcgcccaggctggatgtcaagggaaataacagatttgcagggagtanatgtaggggtggccttggtagagaaggaagagagttccttagcttctgcgcacgcttcttccctccctattagtcttttctggggaagaggacagaatgggtgaagcacttgccaccatagacactggccaggttcctcatgcaatattaggtacgaacagagcaggcaagcacagcttggggcaggactcaccagaaatcaatcccttctggtcctgggagggggatcaagggtaagagttgagtgggtgtgcctgggtcagggtaagagaaattttgaggcttgggaaagggc

SEQ ID NO: 1941 - DNA, 439 bp, Homo sapiens
tttttttttcattttgttaaaaatatttatttaaaaaaatacaactgctgtccatatctagttgcacatatatctattaacatatatgtatacttttagacttgtagtaaatttgctacagtgcttttgtaaagccagcctgcattatacaaagcaaattcctctgtcagttcttacataaaatagatttttaaaaatgtatatctttcctaaaagatgcatatcaccattatagaatttaacaaaatttttgcataaaacctgggaagtgatagaaaaaatgatcacctgattggtcagagcaaccccttactatgtctggagatgcactgagtatcaactacacattttttttttcaagcagcatattattataaagccctcaaagtgcttttgcatcctttcgctcacctctctacactctataaagtttctctgc

SEQ ID NO: 1942 - DNA, 3030 bp, Homo sapiens
aaaaaaaaagggtcccctgtctaccagagcagagcctccctctccaaggctctgttgctccccctctctagctccctcaccctctccctttctctacttccctctccaccttgctctctctctctctcgcagtttccccgtccctctctgtctctctctctatcgctgtttctctctctccttccgtttctatctctccatccctctgtcccttgctcttcttcaagctgtctgtgtctttgtgtgtctgcgtgtatgcttgtgttcccgcgcgtgcgcccgtatgtgtctgtttgggagtgggtttgctagtgattgtggtggggtgtgtctggatgtccgtcagtacctttgtcctgggatcaggctgccaactctattgccagcgcgtgggtgtcatagttgccgtgatagtctcacacacgcaggtgtgtggatctcgttcattttcatgtagacaatgagagcgaaagcacagagaaaaagaaacgtcccgtgcatcacggcctgaggatggattcctgttttctgcaaaatggggagtcttcgatatagcctgtttgaaaactggaaaggagagcaccgacacgatgctggtcttccacgcattcctggaagtttctgggtccccacagagctcgggaaacagtcaacatggtcacgctttccgggggcggcagagacttgagtaacaggcacctttgcagagagcaaagaaacgtggaatccagaatcacgcttcacttggcctgagcgtgacttctgtgtggatgggactatccgcctcgcgctctgttgcagggctaaacgtggggatatgtcatctgtgaaccatgtggatgaaaaacagacaaccacccgagtctccgctcattgctctctggggaattcgctcattccttcggaaacggaattcgtctgaatcgctctgggatgaagtaacccaggctggcgatccggagggccgctgagctccccaccggccaacggggctgtgggcccagcacttagcccgcactgggcacccaacattttcccggattgctgggtcctgttggttctggaggcagaagaccgtttttctgtctgccttcggttctctgtttcttgctccttttgtccctcggtccatcctgccctctgttcttccctccctgccctggttttttcctccctttctccctctctccctcttcctctcccttccagggtccctccgtccatccatcctttcctagctccatccttccgtcccactctgtctccgttcctgtcctcatctctgcctgccttccctcttgcctggaaagggcagcaccccggtttgcgcggggtctcgggtctacatttagttgcaaggcgctccatggtgctggcgaggaggctggtgggacacgggttggcaagtgatagtgagagaagaggcagaggaatcgagccgcagaaaggagaactggcctggcttctgccccgacccagtgtttcgcggactgaggtctccgccaacccgactgaagaacgcggggggaaaagggatgcgagctccgcctgggctggttagaaaacctaagctgttgcctgcaaacccccgcatgagcagtagacagtccacctcccggtacgtggacgggccctgggatccccgggatgctcaggaaagaatgacagccctcctctgtgtggagtctctcgccggacctggaacccagggatcctagacaggtcaactggaagggaagacacgcctctccataccgagccagaggttcaccgccaaagagaggccgccgccctgcccccgccccgccccaacccggcgtcctaaagctcctccagcagagccccgtgttcttcctggctgaggagtggttccagcggagcaggctcttccacctccttcagctcccccagtgacaccggatctaggaaaggttgtgccttttgctgaaagtctggggttgacgggagctcatctaacaggctggagttttcaggcagaaaccaccctgaagggtggagtgtggaactgtacttccatgacagtcttgagttttccatgccctctccgtgaaggcggcaatgcctgtgggtgtcgccgttgccgtgatagtctcacacacgcagtggtgtggaactcgttcattttcatgtagaaaacgagagcgaaactacagagaaaagaaacgtcccgtgcatcacggcctgaccacggattcctgtttcctgcaacaagggaagtctccactgtggcctgtttggaaactggaaaggagagcgaagacaggatgctgcttttccacgcttcgctggaggtttctgggtccccacagagctcgggaaacagtcaacatggtcacgcttttgggggccggagacacgtgaacaacaggcccccttgcagagggcaaaggaacgtggaacccagaatcatggttcactcggtctgagtgtgactcttgaatggacgggactatccacctcgcgctctgttgcaggctcaacgtggggctatgtcatctgtgaaccatgtggatgaaaaacggacaatcacccgagtctcagctcactgctctctgggcaattcgctcattccttgggaggcggaattcgtctgaatcgctccgggatgaagtgacccaggctggcgatccggagggcccgtgagcgccccgcaggcagacgtggctgtgggccgagcactcagcctgcactgggcacccaacattttcccggagtgcgaggtcctgctggtcctggaggcagaagaccgcttttctctctgccttcttctctctgtctcttgctccctttctctctctgtccttcccttcctccctccccccccacctcccttcctccccctccctactttctcctttccaatatccctctgtccatctgtccttttctcgctccattcctccctttctctctgtttctgttcctctccccatctctatttttcaacattatatgatcccattgtgtgtatctgtgttaacatttttagcaataaagttcattttcatt

SEQ ID NO: 1943 - DNA, 311 bp, Homo sapiens
tttttttttttttttttcctttgagatcattattttctgaagatttaattcattattttcaatgtggtacatacgggtggggataaaaaggagaaaggaatatagttgaaggctgtgtgatctgccatgtgccatgtgatcctccctgcaaaaccacaaatctccagtaaaatctgtaaagaaaaaaaaatggtcagatgtctgcctcaagtagatttattaaaggaattggagaaggggctaagttttgtcttctgggtgtctctgggtataacagggacgacccctgagggtttataagcctcgtgccg

SEQ ID NO: 1944 - DNA, 566 bp, Homo sapiens
tttttttttttttctgatttaaaaatagttactaactttatttgtattcgttttaaaaacagaacttgttacaggtaatcacgaagcttccaaaaaaaaattacattctgcttttgtcatcttgataggacaaggaatgtttagatgtccttaaaacacagggtaaagttgacaaataacaaactactacaaactatggattgtcacttcaagcacactaaaatgtggaatacatgtacataaattactgaccagttttttgcaatacaaagagtatgcactacagcttatataccataaaggtaacatgccccaaaatataacagaagatcacaaacacgttcggagaaaataataactttgactcttgggttcaattaagattgaagtgaaatgattgggaaagttttctgaaacttgaagggcacgcacattatagcagaaccgtcaatcaacaatcacgtggggttgaaaagcagcaagaagaatatggcacggtaacaggggtaaccacctttctctctcctcagtccccaatttgagttaggaagattgaggaataaaca

SEQ ID NO: 1945 - DNA, 2577 bp, Homo sapiens
agcatatgtaacatgacctgtgcttcagtgttcttttgtgatcaaaaattccttacttttagttttttatctatggtagaaccacccagagcaggggtcctcaactcccaggccacagactcataccagtccacggactattatgaaccacaccacacaggaggaggtgagcactaggcaagccaaggaagcttcacctgtacttacagccacacgccatggctcatattacagcctgaactctgcctccactcagatcagtgataacattagaaactcattggagcacgaaccctgttgtgaactgcctatccgaaggatctaggttgtgtgcttcgtatgagaatctaatgccagatgatctatcattgtctcactttgcccccagataagaccatctagttgcagaaaaataagctcagagcttccactgattctacattatggatatgtgccgccgaagcaagcacaaagccctacttttacacatgcctagtgatgcttcatggacaaggcttggctctgttgagtccaactaacctacctgagattctgagatttctcttcaatggcttcctgtgagctagagtttgaaaatatcttaaaatcttgagctagagatggaagtagcttggacgattttcattatcatgtaaatcgggtcactcaaggggccaaccacagctgggagccactgctcaggggaaggttcatatgggactttctactgcccaaggttctatacaggatataaaggtgcctcacagtatagatctggtagcaaagaagaagaaacaaacactgatctctttctgccacccctctgaccctttggaactcctctgaccctttagaacaagcctacctaatatctgctagagaaaagaccaacaacggcctcaaaggatctcttaccatgaaggtctcagctaattcttggctaagatgtgggttccacattaggttctgaatatggggggaagggtcaatttgctcattttgtgtgtggataaagtcaggatgcccaggggccagagcagggggctgctgctttgggaacaatggctgagcatataaccataggtatgggaacaaaaaacatcaaagtcactgtatcaattgccatgaagactcgagggacctgaatctaccgattcatcttaaggcagcaggaccagtttgagtggcaacaatgcagcagcagaatcaatggaaacaacagaatgattgcaatgtccttttttttctcctgcttctgacttgataaaagggaccgtcttccttggatttagtgaacccctttggttcctgaaaaattcaaggagtatctaggacatagtccccagaagacagtacaagactttctgataaactggacatttcaagacccaaataactaatcagaaaaatcaaagatgtgatactattttttatcccatgcataggtgctacacttggatcaaatgaacaatgttgggatctttatggataaaggtcttaaaagtcctgagataaagaatcctgcacccactggtacttctaacttgtcttgttttttgtctgatttctggctgatgcaggggactaactcactgccacgcgaaaactacctgaactgaactatgacatctcacctgatatgtaagatgtaactgttataattattttaaacctcaatttagcattaactagccttttaatgtaaacacttacacattatgatgactagaaacagcatactctctggccgtctgtccagatagatcttgagaagatacatcaatgttttgctcaagtagaaggctgactatacttgccgatccacaacatacagcaagtatgagagcagttctaaaatgacagagataggaacagtaataaagttattgtaaaagctaatttgatatactttaccaatttaacatcttgcctgtccgtgcagaatcaaacatttacatgcactaaaagacataagcatcttcagtgctcaagtgttcatctttgtaaaataccaccaaggttaaaaggaagggacaaaaaaaaaaaaccctcttatctcagtggggtattgcatagcagaagctactaatttgaagtcctttgatggacaagaaacaatattagggccacttatctgaaatgaacaaagatttaagtgaagatttcatcacagcttccctagactgatatgctgtaatagaaaatcagctagggggtaaaataaataagagctctctgcatgctgaaagcaagtaagattaataataatggtaagaatagtagtcacaggagtttcagttaatgatgccaataagcatgtgctaggcactgaattaaatgccacatatatctttcttatgcgcagcaaactttgaaggatatattctcctacttttcatatatgacaacatatttggtggtaaataacgttcccaaggtcacacacctagcaagtaagaaagttaggaattaaacccagtattgtgtgaatctaaagcctaacttttttctctttatcacccacctacggcttgtcttcattaaaggaaaagtgtatccacttaaaaaaaaaaaaaa

SEQ ID NO: 1946 - DNA, 1146 bp, Homo sapiens
tcgcttgaacccaggaggtagaggttgcagtgagccaggactgcgccaccacactccagcctgggcgacagagctgtcggcaagctgaggagcaaagatgccagtccaagtcccaaagctgaagaacttggattccaatgtcgaggtcaggaagcatccagcaggggaaaacgtgagctgtgattccccctgaaggatcccagactccattcccaagcactttctccagtgccagcaaagtcctcattggtggcaacaggaatacagtctgcacttgcagccctggcaggcagccagcaccgtcagtggaaaactttaagacgctggggcatcttagagcatccacagtgggtgctgtcggctgcacactgcctccagaaatgctgtgattgccatccagtcccagactgtgggaggctgggagtgtgagaagctttcccaaccctggcagggttgtaccatttcggcaacttccagtgcaaggacgtcctgctgcatcctcactgggtgctcactactgctcactgcatcacccggaacactgtgatcaactagccagcaccatagttctccgaagtcagactatcatgattactgtgttgactgtgctgtctattgtactaaccatgccgatgtttaggtgaaattagcgtcacttggcctcaaccatcttggtatccagttatcctcactgaattgagatttcctgcttcagtgtcagccattcccacataatttctgacctacagaggtgagggatcatatagctcttcaaggatgctggtactcccctcacaaattcatttctcctgttgtagtgaaaggtgcgccctctggagcctcccagggtgggtgtgcaggtcacaatgatgaatgtatgatcgtgttcccattacccaaagcctttaaatccctcatgctcagtacaccagggcaggtctagcatttcttcatttagtgtatgctgtccattcatgcaaccacctcaggactcctggattctctgcctagttgagctcctgcatgctgcctccttggggaggtgagggagagggcccatggttcaatgggatctgtgcagttgtaacacattaggtgcttaataaacagaagctgtgatgttaaaaaaaaaaaaaaaaaaaaaaa

SEQ ID NO: 1947 - DNA, 3533 bp, Homo sapiens
ggcctgagctctcctggcccctggctctcttctgcagagggcctgctctcagctgccacaagagggcgccggagaacggacctgagcaagagaggcaggagctcctctgcaggtcctcccaggcaccaatccttctgggagggaggaaggcttgggagtcctcttagacagatcctcagtcacttctctctgcttgtgtctcaggaagaccagctcctcctactgtcttctgtgctagggatcacttccttgttgagtggggcctgagttttaagaggatcttctgctcctcttcatctggtccctttccttccaaggcctcagagaggaaggcatgcagtgggccctagcggtgcttctagctttcctgtctcctgccagtcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttatggaagcacaaggaagaacttgagaatgatactgcgaaatcttattgaaaatgactctggagtctattactgtgccacctgggaagggacactggttggttcaagatatttgctgaagggactaagctcatagtaacttcacctgataaacaacttgatgcagatgtttcccccaagcccactatttttcttccttcaattgctgaaacaaagctccagaaggctggaacatacctttgtcttcttgagaaatttttccctgatgttattaagatacattgggaagaaaagaagagcaacacgattctgggatcccaggaggggaacaccatgaagactaatgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttcttatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgacttttgtccatggtattttaattggatgacatcaaattgaacatccaaggtaagaaacagcatggcaattgggctgtggaattctgtattggttgtaagaatggtccaacaccccatttctaattctttccctgagatcgtggttatcacaccttctaagaagaactacaaccaaatgaaggagctcatgtgacttctgtttgaaaggtcaccagagtcagattcattcggtttaggacattccagtggctataggacactatctactgtgacgcgtaccgtgtgagctcagctctagagtgtttcacagacactgtgtttcctgatcctcacgatacccccatgagagctgccctaaaagcagagaggcagcgtgatggagaggttcagcacatgctctctgatcccaggaatcctgggtatggtgtttcgtatctgtgtgacctcaggtgagttccaggaactctatgtgccataatctcctcatgtaaaatgaagttataatgccccgtttcctggagttatgtggattagatgagttaatgacacctggcacatgcaagtcctccacagtgtcggcacgcactgttggtagctctactctagagacagtaataaaccaaaaagtatctgacacaggcctcaatcaacttagaagtttattttgcctatgttaagggcatgcccaacttcctgagataataatttatttcataagaatattttaaaaactcgagtaaacttgttaatgtttattgctgcagccactctgtccatctccaccatcactgcaacaacgcaggtccttgttgcctcttattggcttatggtgaccacctataaaaccatctgcttcacccaaattgctgtcctggggagtgccccttcctttctgcttgcacatttatcttcctcaagtgcaaatgtgatcatgtgactttcctccctaaatctttcagcaagtcctcattgtctattcttctttcaaaaacatttatttgaaaatactattaaaatagaaaattttccacattcttacttcttaaaaattaatgtgttttaagtttctcctactccatttccatcccatgcctctttactcaatggatgcaattattcttctacatgttccttctggccatgtgtagctttgtcattttaattttaatctatttggaccctgtgttatctgggatgaggtagagtgatatttttattttctcaggtaattatttgcctaatgcctgtttccaaataatccaccatttccttacaatttaaaaatgctccagcatgtttttaatagctacacatatttgacacattttctggagaatttctgttttatttgtctatttcattattcttgtatcattatcatattatctcagtagctttgtggcaagtattaagatctactatgccaaatgtctattcactgtaccatttttcagaaaattctttttcaatcatctcatatttattcactcctgtagaatttaaaatcaacttatctagcccaacattaaacctcacaccctagaacaacaacatgtcgtagtaattctgactaaaattgctggaaatttatagatgaatttagggtgtattggcctctttatgatagaagctttttattcatcaatgtatgtttctccatttatttaggttttatgttatgcccttaggaaaactaaatactgtgttcttcatatcattcttgtatttttttggtaaatttaataaaagattttataattcaaaaaaaaaaaaaaaaaaaaaaaaaaaaaaaaaaaaaaaaaaaaaaaaaaaaaaaaaaa

What is claimed is:

1. A method for identifying a set of at least 5 organ-specific proteins that are specifically produced in a preselected organ and are shed into the blood comprising,
   (a) determining, using mRNA transcripts, the sequences of sequences 17-20 nucleotides long that have been identified as signature sequences characteristic of mRNA transcripts that encode proteins from substantially all mRNA transcripts isolated from a sample of said preselected organ;
   (b) comparing, using a computer, the signature sequences to a database of known RNA transcripts to identify the mRNA transcripts that encode proteins to obtain a preliminary set of mRNA transcripts;
   (c) comparing, using a computer, the identified mRNA transcripts to mRNA transcripts known to be expressed in other organs;
   (d) removing, using a computer, from said preliminary set any mRNA transcripts that are known to be substantially expressed in other organs thus obtaining an intermediate set of mRNA transcripts;
   (e) identifying, using a computer, from the remaining mRNA transcripts in the intermediate set those mRNA transcripts that include a sequence encoding a signal peptide, thereby identifying transcripts that encode organ-specific secreted proteins from said preselected organ; and
   (f) confirming, using a blood sample, the presence of the organ-specific secreted proteins by assessing the blood sample, thereby identifying a set of at least 5 organ-specific proteins from said preselected organ that are shed into blood.

2. The method of claim 1 wherein one of said at least 5 organ-specific proteins identified is carboxypeptidase E precursor (CPE) having SEQ ID NO:1520 or olfactory receptor, family 51, subfamily E, member 2 (OR51e2) having SEQ ID NO:1740.

3. A method for identifying a set of at least 5 organ-specific proteins that are specifically produced in a preselected organ and are shed into the blood comprising,
   (a) determining, using mRNA transcripts, the sequences of sequences 17-20 nucleotides long that have been identified as signature sequences characteristic of mRNA transcripts that encode proteins from substantially all mRNA transcripts isolated from a sample of said preselected organ;
   (b) comparing, using a computer, the signature sequences to a database of known RNA transcripts to identify the mRNA transcripts that encode proteins to obtain a preliminary set of mRNA transcripts;
   (c) identifying, using a computer, from among the mRNA transcripts identified in (b) as encoding proteins, those mRNA transcripts that are expressed in the preselected organ at a level at least 2.5 times the level of expression of the same mRNA transcripts observed in other organs;
   (d) identifying, using a computer, from the transcripts in (c) those transcripts that include a sequence encoding a signal peptide, thereby identifying transcripts that encode organ-specific proteins secreted or shed into the blood; and
   (e) confirming, using a blood sample, the presence of the organ-specific secreted proteins by assessing the blood sample thereby identifying a set of at least 5 organ-specific proteins shed into blood.

4. The method of claim 3 wherein an identified organ-specific protein is carboxypeptidase E precursor (CPE) having SEQ ID NO:1520 or olfactory receptor, family 51, subfamily E, member 2 (OR51e2) having SEQ ID NO:1740.

* * * * *